United States Patent 12,508,308 (INFLUENZA mRNA VACCINES) - sequence listing, part 52

SEQ ID NO: 202460 - RNA, 1410 nt, Artificial Sequence
  derived and/or modified sequence opt5 from neuraminidase__InfluenzaA__ADM13094
augaaccccaaucagaagaucauuaccaucggcagcgugugcaugacaauugggauggccaaccugauccuccaaauuggaaauacgaucuccaucuggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgcgaaacuugcuggaaauucuagccugugcccuguguccggcugggccaucuacagcaaggacaacucuauuagaaucggguccaaaggagauguuuuugugauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggucccuucccccuacaacagccgcuuugaauccguggcuuggucugccagcgcuugccacgacggaaucaauuggcugacaauuggcaucuccgggccugauaacggagccguugcggugcugaaguauaauggcaucauuaccgacacaaucaagagcuggagaaacaauauucuccggacccaagagucugagugugccugcgucaacggguccuguuucacggugaugacagauggaccgagcgacggccaggcuucuuacaaaaucuuucgcauugaaaagggcaaaaucgucaagagcguggagaugaaugcccccaacuaucauuacgaagagugcuccuguuacccugauucuagcgagauuaccugcguuugcagagacaauuggcacggguccaaccggcccugggugagcuucaaucagaaccuggaauaucagaucggauacaucuguucuggcauuuuuggggauaauccucgccccaacgacaaaacaggauccugcggcccggugagcucuaauggggcuaacggagucaagggcuucuccuuuaaguauggcaacgggguguggaucggaagaaccaaaagcauuuccucucggaauggcuucgagaugaucugggauccuaacggguggaccggaacagacaauaacuuuagcauuaagcaagacaucguuggcaucaaugaaugguccggguacucuggcagcuucgugcagcaucccgagcuuacgggacuggauuguauucgcccuugcuucugggucgaacucaucagaggccggcccaaagagaacaccauuuggacauccgggagcucuaucuccuuuuguggagugaauagcgacaccguuggcuggucuuggcccgauggggccgagcugccuuucacaauugacaaguga

SEQ ID NO: 202461 - RNA, 1410 nt, Artificial Sequence; identical to SEQ ID NO: 200939
  derived and/or modified sequence opt5 from neuraminidase__InfluenzaA__ADM13104

SEQ ID NO: 202462 - RNA, 1410 nt, Artificial Sequence; identical to SEQ ID NO: 201664
  derived and/or modified sequence opt5 from neuraminidase__InfluenzaA__ADM13124

SEQ ID NO: 202463 - RNA, 1410 nt, Artificial Sequence
  derived and/or modified sequence opt5 from neuraminidase__InfluenzaA__ADM13134
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauacacuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaaagggauccugcggcccggucagcucuaauggggccaacggagugaagggcuucuccuuuaaauauggcaacgggguuuggaucggaagaacaaagagcauuuccucucggaauggcuucgagaugaucugggauccuaacggguggaccggaaccgacaauaacuuuagcauuaaacaagacaucgugggcaucaaugaaugguccggguacucuggcagcuucguccagcaucccgagcuuacaggacuggauuguauucgcccuugcuucuggguggaacucaucagaggccggcccaaggagaacacgauuuggaccuccgggagcucuaucuccuuuuguggaguuaauagcgacacagugggcuggucuuggcccgauggggcugagcugccuuucaccauugacaaauga

SEQ ID NO: 202464 - RNA, 1410 nt, Artificial Sequence
  derived and/or modified sequence opt5 from neuraminidase__InfluenzaA__ADM13154
augaaccccaaucagaagaucauuaccaucggcagcgugugcaugacaauugggauggccaaccugauccuccaaauuggaaauaucaucuccauuuggaucucucacagcauucagcugggcaaccagaaacagaucgagacguguaaucaauccgucuucaccuacgaaaacaauacauggguuaaccagaccuaugugaauauuucuaacacaaauuuugcugccgggcagagcguggucuccgugaaacuugcgggaaacucuagccugugcccuguuuccggcugggcuaucuacagcaaggacaauucuauuagaaucggguccaagggagauguguucgucauccgggagccguuuauuagcuguucuccccucgaaugccgcaccuucuuucugacacagggcgcccuucugaacgacaaacauuccaauggcaccaucaaggauagaagcccuuaucggacgcucaugucuugucccauuggggaggugccuucccccuacaacagccgcuucgaauccguugccuggucugcuagcgccugccacgacggaaucaacuggcugaccauuggcaucuccgggccugauaauggagcuguggccguccugaaguauaacggcaucauuacagacaccaucaaaagcuggagaaauaacauucuccggacacaagagucugagugugcgugcgugaauggguccuguuuuaccgugaugacggauggaccgagcgacggccaggccucuuacaagaucuucaaaauugaaaagggcaaaaucgucaagagcguugagaugaacgcucccaauuaucauuacgaagagugcuccuguuacccugauucuagcgagaucacaugcgugugccgcgacaacuggcacggguccaauagacccugggugagcuuuaaccagaaucuggaauaucagauuggauacaucuguucuggcauuuucggggauaacccucggcccaaugacaagaccggauccugcggcccggucagcucuaacggggccaauggagugaaaggcuuuuccuucaaguauggcaacgggguuuggaucggacgcacaaaaagcauuuccucuagaaacggcuuugagaugaucugggauccuaauggguggaccggaaccgacaacaauuucagcauuaagcaagacaucgugggcaucaacgaaugguccggguacucuggcagcuucguccagcaucccgagcuuacaggacuggauuguauucggccuugcuuuuggguggaacucauccgcggcagacccaaagagaauacgauuuggaccuccgggagcucuaucuccuucuguggaguuaacagcgacacagugggcuggucuuggcccgauggggcugagcugccuuuuaccauugacaaguga

SEQ ID NO: 202465 - RNA, 1410 nt, Artificial Sequence; identical to SEQ ID NO: 201192
  derived and/or modified sequence opt5 from neuraminidase__InfluenzaA__ADM13164

SEQ ID NO: 202466 - RNA, 1410 nt, Artificial Sequence; identical to SEQ ID NO: 199762
  derived and/or modified sequence opt5 from neuraminidase__InfluenzaA__ADM13174

SEQ ID NO: 202467 - RNA, 1410 nt, Artificial Sequence; identical to SEQ ID NO: 199762
  derived and/or modified sequence opt5 from neuraminidase__InfluenzaA__ADM13184

SEQ ID NO: 202468 - RNA, 1410 nt, Artificial Sequence; identical to SEQ ID NO: 199762
  derived and/or modified sequence opt5 from neuraminidase__InfluenzaA__ADM13194

SEQ ID NO: 202469 - RNA, 1410 nt, Artificial Sequence; identical to SEQ ID NO: 199762
  derived and/or modified sequence opt5 from neuraminidase__InfluenzaA__ADM13204

SEQ ID NO: 202470 - RNA, 1410 nt, Artificial Sequence; identical to SEQ ID NO: 200939
  derived and/or modified sequence opt5 from neuraminidase__InfluenzaA__ADM13214

SEQ ID NO: 202471 - RNA, 1410 nt, Artificial Sequence
  derived and/or modified sequence opt5 from neuraminidase__InfluenzaA__ADM13224
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuagaagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcaagauuacaugcgugugccgggacaauuggcacggguccaaccgccccugggugagcuucaaucagaaccuggaguaucagaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgaaaugauuugggauccuaacggguggaccggaaccgacaauaacuuuagcaucaagcaagacaucgugggcauuaaugagugguccggguacucuggcagcuucguccagcaucccgaacuuacaggacuggauuguaucagaccuugcuucuggguggagcucauucggggccgccccaaagaaaacacgaucuggaccuccgggagcucuauuuccuuuuguggaguuaauagcgacacagugggcuggucuuggcccgauggggcugagcugccuuucaccaucgacaaguga

SEQ ID NO: 202472 - RNA, 1410 nt, Artificial Sequence; identical to SEQ ID NO: 199762
  derived and/or modified sequence opt5 from neuraminidase__InfluenzaA__ADM13234

SEQ ID NO: 202473 - RNA, 1410 nt, Artificial Sequence; identical to SEQ ID NO: 201050
  derived and/or modified sequence opt5 from neuraminidase__InfluenzaA__ADM13244

SEQ ID NO: 202474 - RNA, 1410 nt, Artificial Sequence; identical to SEQ ID NO: 200116
  derived and/or modified sequence opt5 from neuraminidase__InfluenzaA__ADM13254

SEQ ID NO: 202475 - RNA, 1410 nt, Artificial Sequence; identical to SEQ ID NO: 200939
  derived and/or modified sequence opt5 from neuraminidase__InfluenzaA__ADM13264

SEQ ID NO: 202476 - RNA, 1410 nt, Artificial Sequence; identical to SEQ ID NO: 199762
  derived and/or modified sequence opt5 from neuraminidase__InfluenzaA__ADM13274

SEQ ID NO: 202477 - RNA, 1410 nt, Artificial Sequence; identical to SEQ ID NO: 199762
  derived and/or modified sequence opt5 from neuraminidase__InfluenzaA__ADM13284

SEQ ID NO: 202478 - RNA, 1410 nt, Artificial Sequence
  derived and/or modified sequence opt5 from neuraminidase__InfluenzaA__ADM13294
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucgggcccucaugucuugucccaucggggaggugccuucccccuacaacagccgcuuugaauccguugcuuggucugccagcgcuugccacgacggaauuaauuggcugacgaucggcaucuccgggccugauaacggagccguggcgguccugaaguauaauggcauuaucaccgacacaauuaagagcuggagaaacaauauccuccggacccaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaccgacaauagcuuuuccaucaagcaagacaucgugggcauuaacgaauggucuggguacagcggcuccuucguccagcaucccgagcuuaccggacuggauuguauccgcccuugcuucuggguggaacucauuagaggccggcccaaagagaauacaaucuggacgagcgggucuuccauuagcuuuuguggaguuaacucugacaccgugggcugguccuggcccgauggggccgagcugccuuucacaaucgacaaguga

SEQ ID NO: 202479 - RNA, 1410 nt, Artificial Sequence; identical to SEQ ID NO: 199762
  derived and/or modified sequence opt5 from neuraminidase__InfluenzaA__ADM13304

SEQ ID NO: 202480 - RNA, 1410 nt, Artificial Sequence; identical to SEQ ID NO: 201224
  derived and/or modified sequence opt5 from neuraminidase__InfluenzaA__ADM13314

SEQ ID NO: 202481 - RNA, 1410 nt, Artificial Sequence; identical to SEQ ID NO: 199762
  derived and/or modified sequence opt5 from neuraminidase__InfluenzaA__ADM13324

SEQ ID NO: 202482 - RNA, 1410 nt, Artificial Sequence
  derived and/or modified sequence opt5 from neuraminidase__InfluenzaA__ADM13344
augaaccccaaucagaagaucauuaucauuggcagcgugugcaugaccaucgggauggccaaccugauucuccaaaucggaaauaucauuuccaucuggauucugcacucuauccagcuuggcaaccagaaucagauugagacauguaaccaaagcgucaucacguacgaaaauaacaccuggguuaaucagacauaugugaacauuuccaauaccaacuucgcugccgggcagucuguggucagcgugaaacuggcgggaaauuccucucucugcccuguuagcggcugggcuaucuacuccaaggacaacagcaucagaauugggucuaaaggagauguguuugucauccgggagccguucauuuccuguagcccccuggaaugccgcacauuuuuccuuacccagggcgcccugcucaaugacaagcauucuaacggcacaaucaaagauagauccccuuaucggacccugaugagcugucccauuggggaggugccuucucccuacaacucccgcuuugaaagcguugccugguccgcuucugccugccacgacggaaucaauuggcugacgaucggcauuagcgggccugauaacggagcuguggccguccucaaguauaauggcaucauuaccgacacaaucaaguccuggagaaacaauauucugcggacccaagagagcgagugugcgugcgugaacgggucuuguuucacagugaugaccgauggaccguccgacggccaggccagcuacaaaaucuuucgcaucgaaaagggcaaaauugucaagucuguugagaugaaugcucccaacuaucauuacgaagagugcagcuguuacccugauuccucugagaucacgugcgugugcagagacaauuggcacgggagcaaccggcccuggguguccuucaaucagaaccuugaauaucagauuggauacaucuguagcggcauuuuuggggauaauccucgccccaacgacaaaacaggaucuugcggcccggucuccagcaauggggccaacggagugaagggcuucucuuuuaaguauggcaacgggguuuggaucggaagaaccaaauccauuagcucccggaauggcuucgagaugaucugggauccuaacggguggacaggaaccgacaauaacuuugcuaucaagcaagacauugugggcaucaaugaauggucuggguacagcggcuccuucguccagcaucccgagcugaccggacucgauuguauucgcccuugcuucuggguggaacugaucagaggccggcccaaagagaacacaauuuggacgucugggagcuccaucagcuuuuguggaguuaauucugacaccgugggcugguccuggcccgauggggccgagcuuccuuucacaaucgacaaguga

SEQ ID NO: 202483 - RNA, 1410 nt, Artificial Sequence; identical to SEQ ID NO: 201664
  derived and/or modified sequence opt5 from neuraminidase__InfluenzaA__ADM13354

SEQ ID NO: 202484 - RNA, 1410 nt, Artificial Sequence; identical to SEQ ID NO: 200939
  derived and/or modified sequence opt5 from neuraminidase__InfluenzaA__ADM13363

SEQ ID NO: 202485 - RNA, 1410 nt, Artificial Sequence
  derived and/or modified sequence opt5 from neuraminidase__InfluenzaA__ADM13464
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcaaugacaaaaacgccacagcuagcuucaucuaugaugggcggcuggucgacucuauuggauccuggagccaaaauauccuucgcacccaggagucugaaugcguguguaucaacggcacaugcaccguggucaugaccgauggguccgccagcggcagagcggacacacggauucuguuuaucgaggagggaaaaauuguucauaucagcccccucucugggagcgcccagcacguggaagagugcuccuguuacccucgcuaucccggagugagaugcauuugucgggauaauuggaagggcagcaaccgcccugucguggacaucaacauggaagacuacucuaucgauuccagcuacguuugcucuggccuggugggggacacgcccagaaaugaugaccggagcuccaacucuaauugucgcaacccgaauaacgagagaggaaaucagggcgucaaagggugggcuuucgauaacggagacgauguguggaugggccggaccauuagcaaggaccuuagauccggguaugaaacauuuaagguuaucggaggcuggagcaccccuaauucuaaaucccaaauuaaccgccaggugaucgucgauagcgacaaucggucuggcuacuccgggauuuucagcguggagggaaaguccugcaucaacagauguuuuuaugucgagcugauucgcggccgggaacaggagacaagagugugguggaccucuaauagcaucguuguguucugcgggacguccggaacauacggcaccgggucuuggcccgauggcgccaacaucaauuuuaugccuauuuga

SEQ ID NO: 202486 - RNA, 1410 nt, Artificial Sequence
  derived and/or modified sequence opt5 from neuraminidase__InfluenzaA__ADM13465
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaacugucgcaauccgaacaaugagagaggaaaccagggcgucaaagggugggcuuucgacaauggagaugacguguggaugggccggaccauuagcaaggaucuuagauccggguaugaaacauuuaagguuaucggaggcuggagcaccccuaacucuaaaucccaaauuaaucgccaggugaucgucgacagcgauaaccggucuggcuacuccgggauuuucagcguggagggaaaguccugcaucaauagauguuuuuaugucgagcugaugcgcggccggaaacaggaaacaagagugugguggaccucuaacagcauuguuguguucugcgggacguccggaacauacggcaccgggucuuggcccgacggcgccaauaucaacuuuaugccuaucuga

SEQ ID NO: 202487 - RNA, 1410 nt, Artificial Sequence; identical to SEQ ID NO: 197119
  derived and/or modified sequence opt5 from neuraminidase__InfluenzaA__ADM13466

SEQ ID NO: 202488 - RNA, 1410 nt, Artificial Sequence
  derived and/or modified sequence opt5 from neuraminidase__InfluenzaA__ADM13467
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccucuggaggcgacaucugggugacgagagagcccuaugucagcugugaucaugggaagugcuaccaguucgcucugggacagggcaccacacuugacaacaagcacuccaaugauaccauccaugaccggauuccucaccgcacacugcucaugaacgaacugggggugccguuucaucugggaaccagacagguuuguaucgccuggucuagcuccagcugccacgauggcaaagccuggcuccacguguguauuacgggcgacgauaagaaugcuacagccucuuucaucuaugacgggcggcuggucgauuccauuggaagcuggucucaaaacauccuucgcacccaggaguccgaaugcguguguaucaauggcacaugcaccguggucaugaccgacgggagcgcuuccggcagagccgauacacggauucuguuuaucgaggagggaaaaauuguucauaucucuccccucagcggguccgcgcagcacguggaagagugcagcuguuacccucgcuaucccggagugagaugcauuugucgggacaacuggaagggcucuaaucgcccugucguggacaucaacauggaagauuacuccaucgacagcucuuacguuugcagcggccuggugggggauacgcccagaaacgacgaucgguccucuaauagcaacugucgcaauccgaacaaugagagaggaaaccagggcgucaaagggugggccuucgacaauggagaugacguguggaugggccggaccauuuccaaggaucuuagaagcggguaugaaacauuuaagguuaucggaggcuggucuaccccuaacuccaaaagccaaauuaaucgccaggugaucgucgacucugauaaccgguccggcuacagcgggauuuucuccguggagggaaagucuugcaucaauagauguuuuuaugucgagcugauucgcggccggaaacaggaaacaagagugugguggaccagcaacuccaucguuguguucugcgggacgucuggaacauacggcaccgggagcuggcccgacggcgcuaauaucaacuuuaugccuauuuga

SEQ ID NO: 202489 - RNA, 1410 nt, Artificial Sequence; identical to SEQ ID NO: 197119
  derived and/or modified sequence opt5 from neuraminidase__InfluenzaA__ADM13468

SEQ ID NO: 202490 - RNA, 1410 nt, Artificial Sequence
  derived and/or modified sequence opt5 from neuraminidase__InfluenzaA__ADM13469
augaaccccaaucagaagaucauuaccaucggcagcgugucccugacaauugccacggcuugcuuccucaugcaaaucgccauucuggucaccacaguuacccuucacuuuaaacaguacgagugugacucuccugcgagcaaccaggugaugccgugcgaacccaucaucauugagagaaauaucacagaaauuguguaucugaacaauaccacaaucgagaaggaaauuuguccuaaagucguggaguaccggaacugguccaagccccagugccaaaucaccggguucgcuccuuuuucuaaagauaauagcauucgccucuccgccggaggcgacaucuggguuacgagagagcccuaugugucuugugaucaugggaagugcuaccaguucgcccugggacagggcaccacacuugacaacaagcacagcaaugauaccauccaugaccggauuccucaccgcacacugcucaugaacgaacugggggucccguuucaucugggaaccagacagguguguaucgcuugguccuccucuuccugccacgauggcaaagccuggcuccacguuuguauuacgggcgacgauaagaaugcuacagccagcuucaucuaugacgggcggcugguggauucuauuggauccuggagccaaaacauccuucgcacccaggagucugaaugcgucuguaucaauggcacaugcaccguggugaugaccgacggguccgcgagcggcagagccgauacacggauucuguuuaucgaggagggaaaaauuguccauaucagcccccucucugggagcgcucagcacguugaagagugcuccuguuacccucgcuaucccggagugagaugcauuugucgggacaacuggaagggcagcaaucgcccuguggucgacaucaacauggaagauuacucuaucgacuccagcuacgugugcucuggccugguuggggauacgcccagaaacgacgaucggagcuccaauucuaacugucgcaauccgaacaaugagagaggaaaccagggcgugaaagggugggccuucgacaauggagaugacgucuggaugggccggaccauuagcaaggaucuuagauccggguaugaaacauuuaaggugaucggaggcuggagcaccccuaacucuaaaucccaaauuaaucgccagguuaucguggacagcgauaaccggucuggcuacuccgggauuuucagcgucgagggaaaguccugcaucaauagauguuuuuauguggagcugauucgcggccggaaacaggaaacaagagucugguggaccucuaacagcaucgugguuuucugcgggacguccggaacauacggcaccgggucuuggcccgacggcgcuaauaucaacuuuaugccuauuuga

SEQ ID NO: 202491 - RNA, 1410 nt, Artificial Sequence
  derived and/or modified sequence opt5 from neuraminidase__InfluenzaA__ADM13470
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaacugucgcaauccgaacaaugagagaggaaaccagggcgucaaagggugggcuuucgacaauggagaugacguguggaugggccggaccauuagcaaggaucuuagauccggguaugaaacauuuaagguuaucggaggcuggagcaccccuaacucuaaaucccaaauuaaucgccaggugaucauugacagcgauaaccggucuggcuacuccgggaucuucagcgucgagggaaaguccugcauuaauagauguuuuuauguggagcugauccgcggccggaaacaggaaacaagagucugguggaccucuaacagcaucgugguuuucugcgggacguccggaacauacggcaccgggucuuggcccgacggcgccaauauuaacuuuaugccuaucuga

SEQ ID NO: 202492 - RNA, 1410 nt, Artificial Sequence
  derived and/or modified sequence opt5 from neuraminidase__InfluenzaA__ADM13471
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgcaucuccgcuggaggcgacaucugggugacgagagagcccuaugucucuugugaucaugggaagugcuaccaguucgcccucggacagggcaccacacuggacaacaagcacagcaaugauaccauucaugaccggaucccucaccgcacacuucugaugaacgaacucggggugccguuucaucugggaaccagacagguuuguauugccugguccuccucuuccugccacgauggcaaggcuuggcugcacguguguaucacgggcgacgauaaaaaugccacagcuagcuucauuuaugacgggcggcucgucgauucuaucggauccuggagccaaaacauccugcgcacccaggagucugaaugcguguguauuaauggcacaugcaccguggucaugaccgacggguccgccagcggcagagcggauacacggauccuuuuuauugaggagggaaaaaucguucauauuagcccccugucugggagcgcccagcacguggaagagugcuccuguuacccucgcuaucccggagugagaugcaucugucgggacaacuggaagggcagcaaucgcccugucguggacaucaacauggaagauuacucuauugacuccagcuacguuugcucuggccucgugggggauacgcccagaaacgacgaucggagcuccaauucuaacugucgcaauccgaacaaugagagaggaaaccagggcgucaaagggugggcuuucgacaauggagaugacguguggaugggccggaccaucagcaaggaucugagauccggguaugaaacauuuaagguuauuggaggcuggagcaccccuaacucuaaaucccaaaucaaucgccaggugauugucgacagcgauaaccggucuggcuacuccgggaucuucagcguggagggaaaguccugcauuaauagauguuuuuaugucgagcuuauccgcggccggaaacaggaaacaagagugugguggaccucuaacagcaucguuguguucugcgggacguccggaacauacggcaccgggucuuggcccgacggcgccaauauuaacuuuaugccuaucuga

SEQ ID NO: 202493 - RNA, 1410 nt, Artificial Sequence; identical to SEQ ID NO: 199532
  derived and/or modified sequence opt5 from neuraminidase__InfluenzaA__ADM13472

SEQ ID NO: 202494 - RNA, 1410 nt, Artificial Sequence; identical to SEQ ID NO: 197119
  derived and/or modified sequence opt5 from neuraminidase__InfluenzaA__ADM13473

SEQ ID NO: 202495 - RNA, 1410 nt, Artificial Sequence; identical to SEQ ID NO: 199527
  derived and/or modified sequence opt5 from neuraminidase__InfluenzaA__ADM13474

SEQ ID NO: 202496 - RNA, 1410 nt, Artificial Sequence
  derived and/or modified sequence opt5 from neuraminidase__InfluenzaA__ADM14469
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaugagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaccggcuucgagaugaucugggauccuaauggguggaccggaacagacaacaauuuuagcauuaagcaagacaucgugggcaucaacgaaugguccggguacucuggcagcuucguccagcaucccgagcuuacgggacuggauuguauucgcccuugcuucuggguggaacucaucagaggccggcccaaagagaauaccauuuggacauccgggagcucuaucuccuuuuguggaguuaacagcgacaccgugggcuggucuuggcccgauggggcugagcugccuuucacaauugacaaguga

SEQ ID NO: 202497 - RNA, 1410 nt, Artificial Sequence; identical to SEQ ID NO: 199762
  derived and/or modified sequence opt5 from neuraminidase__InfluenzaA__ADM14479

SEQ ID NO: 202498 - RNA, 1410 nt, Artificial Sequence; identical to SEQ ID NO: 199762
  derived and/or modified sequence opt5 from neuraminidase__InfluenzaA__ADM14499

SEQ ID NO: 202499 - RNA, 1410 nt, Artificial Sequence; identical to SEQ ID NO: 201275
  derived and/or modified sequence opt5 from neuraminidase__InfluenzaA__ADM14518

SEQ ID NO: 202500 - RNA, 1410 nt, Artificial Sequence; identical to SEQ ID NO: 202100
  derived and/or modified sequence opt5 from neuraminidase__InfluenzaA__ADM14527

SEQ ID NO: 202501 - RNA, 1410 nt, Artificial Sequence; identical to SEQ ID NO: 201193
  derived and/or modified sequence opt5 from neuraminidase__InfluenzaA__ADM14537

SEQ ID NO: 202502 - RNA, 1410 nt, Artificial Sequence; identical to SEQ ID NO: 199762
  derived and/or modified sequence opt5 from neuraminidase__InfluenzaA__ADM14546

SEQ ID NO: 202503 - RNA, 1410 nt, Artificial Sequence
  derived and/or modified sequence opt5 from neuraminidase__InfluenzaA__ADM14555
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuagauauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 202504 - RNA, 1410 nt, Artificial Sequence; identical to SEQ ID NO: 199762
  derived and/or modified sequence opt5 from neuraminidase__InfluenzaA__ADM14573

SEQ ID NO: 202505 - RNA, 1410 nt, Artificial Sequence; identical to SEQ ID NO: 199762
  derived and/or modified sequence opt5 from neuraminidase__InfluenzaA__ADM14582

SEQ ID NO: 202506 - RNA, 1410 nt, Artificial Sequence; identical to SEQ ID NO: 199762
  derived and/or modified sequence opt5 from neuraminidase__InfluenzaA__ADM14591

SEQ ID NO: 202507 - RNA, 1410 nt, Artificial Sequence
  derived and/or modified sequence opt5 from neuraminidase__InfluenzaA__ADM14601
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcgugagaaucgggucuaaaggagaugucuuugugauccgggagccguucauuuccuguagcccccucgaaugccgcaccuuuuuccugacacagggcgcccuucugaacgacaagcauucuaacggcaccaucaaagauagauccccuuaucggacgcucaugagcugucccauuggggagguuccuucucccuacaauucccgcuuugaaagcguggccugguccgcuucugccugccacgacggaaucaacuggcugaccauuggcaucagcgggccugauaauggagcugucgccgugcugaaguauaacggcaucauuacagacaccaucaaguccuggagaaauaacauucuccggacacaagagagcgagugugcgugcgugaaugggucuuguuucaccgucaugacggauggaccguccgacggccaggccagcuacaaaaucuuucgcauugaaaagggcaaaaucguuaagucuguggagaugaacgcucccaauuaucauuacgaagagugcagcuguuacccugauuccucugagaucacaugcgugugcagagacaacuggcacgggagcaaucggcccugggucuccuucaaccagaaucuggaauaucagauuggauacaucuguagcggcauuuuuggggauaacccucgccccaaugacaaaaccggaucuugcggcccgguguccagcaacggggccaacggaguuaagggcuucucuuuuaaguauggcaaugggguguggaucggaagaacaaaauccauuagcucccggaacggcuucgagaugaucugggauccuaauggguggaccggaaccgacaacaauuuuucuauuaagcaagacaucgucggcaucaacgaauggagcggguacuccggcucuuucgugcagcaucccgagcuuacaggacuggauuguauucgcccuugcuucuggguugaacucaucagaggccggcccaaagagaauacgauuuggaccagcggguccagcaucucuuuuuguggagugaacuccgacacagucggcuggagcuggcccgauggggcugagcugccuuucaccauugacaaguga

SEQ ID NO: 202508 - RNA, 1410 nt, Artificial Sequence
  derived and/or modified sequence opt5 from neuraminidase__InfluenzaA__ADM14611
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuucuggaaauagcucccugugcccuguuagcggcugggcgauuuacucuaaggacaacuccaucagaaucgggagcaaaggagauguguuugucauucgggagccguucaucucuuguagcccccucgaaugccgcaccuuuuuccugacacagggcgcccuucugaaugacaagcauuccaacggcaccauuaaagauagaucuccuuaucggacgcucauguccugucccaucggggaggugccuagccccuacaacucccgcuuugaaucuguugcuuggagcgccuccgcuugccacgacggaauuaauuggcugaccaucggcaucagcgggccugauaacggagccguggcuguccugaaguauaauggcauuaucacagacaccauuaagucuuggagaaacaauauccuccggacacaagaguccgagugugccugcgugaacgggagcuguuucaccgugaugacggauggaccgucugacggccaggcgagcuacaaaauuuuucgcaucgaaaagggcaaaaucgucaaguccguugagaugaaugcccccaacuaucauuacgaagagugcucuuguuacccugauagcuccgagauuacaugcgugugcagagacaauuggcacgggagcaaccggcccugggugucuuucaaucagaaccuggaauaucagaucggauacauuuguuccggcaucuuuggggauaauccucgccccaacgacaaaaccggaagcugcggcccggucucuuccaauggggcuaacggagugaagggcuucagcuuuaaguauggcaacgggguuuggauuggaagaacaaaauccaucucuagccggaauggcuucgagaugauuugggauccuaacggguggaccggaaccgacaauaacuuuuccaucaagcaagacaucgugggcauuaaugaauggucuggguacagcggcuccuucguccagcaucccgagcuuacaggacuggauuguauccgcccuugcuucuggguggaacucauuagaggccggcccaaagagaacacgaucuggaccagcgggucuuccauuagcuuuuguggaguuaauucugacacagugggcugguccuggcccgauggggccgagcugccuuucaccaucgacaaguga

SEQ ID NO: 202509 - RNA, 1410 nt, Artificial Sequence; identical to SEQ ID NO: 199762
  derived and/or modified sequence opt5 from neuraminidase__InfluenzaA__ADM14620

SEQ ID NO: 202510 - RNA, 1410 nt, Artificial Sequence; identical to SEQ ID NO: 199762
  derived and/or modified sequence opt5 from neuraminidase__InfluenzaA__ADM14629

SEQ ID NO: 202511 - RNA, 1410 nt, Artificial Sequence; identical to SEQ ID NO: 199762
  derived and/or modified sequence opt5 from neuraminidase__InfluenzaA__ADM14639

SEQ ID NO: 202512 - RNA, 1410 nt, Artificial Sequence; identical to SEQ ID NO: 199762
  derived and/or modified sequence opt5 from neuraminidase__InfluenzaA__ADM14657

SEQ ID NO: 202513 - RNA, 1410 nt, Artificial Sequence; identical to SEQ ID NO: 199762
  derived and/or modified sequence opt5 from neuraminidase__InfluenzaA__ADM14666

SEQ ID NO: 202514 - RNA, 1410 nt, Artificial Sequence; identical to SEQ ID NO: 199762
  derived and/or modified sequence opt5 from neuraminidase__InfluenzaA__ADM14684

SEQ ID NO: 202515 - RNA, 1410 nt, Artificial Sequence
  derived and/or modified sequence opt5 from neuraminidase__InfluenzaA__ADM14693
augaaccccaaucagaagaugaucaccauuggcagcgugugcaugacaaucgggauggccaaccugauucuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 202516 - RNA, 1410 nt, Artificial Sequence
  derived and/or modified sequence opt5 from neuraminidase__InfluenzaA__ADM14702
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucucaucucgaaugccgcaccuuuuuccugacacagggcgcccuucugaaugacaagcacuccaacggcaccauuaaagauagaagccccuaucggacgcucaugucuuguccuaucggggaggugcccuccccuuacaacagccgcuuugaauccguugccuggucugcuagcgccugccaugacggaauuaauuggcugaccaucggcaucuccgggcccgauaacggagcuguggccguccugaaguauaauggcauuaucacagacaccauuaagagcuggagaaacaauauccuccggacacaagagucugagugugcgugcgugaacggguccuguuucaccgugaugacggauggaccuagcgacggccaggccucuuacaaaauuuuucgcaucgaaaagggcaaaaucgucaagagcguugagaugaaugcuccgaacuaucacuacgaagagugcuccuguuaccccgauucuagcgagauuacaugcgugugcagagacaauuggcauggguccaaccggccuugggugagcuucaaucagaaccuggaauaucagaucggauacauuuguucuggcaucuuuggggauaauccccgcccuaacgacaaaaccggauccugcggccccgucagcucuaauggggccaacggagugaagggcuucuccuuuaaguauggcaacggggcuuggauuggaagaacaaaaagcaccuccucucggaauggcuucgagaugaucugggauccgaacggguggaccggaacagacaauaacuuuagcauuaagcaagacaucguuggcaucaaugaaugguccggguacucuggcagcuucgugcagcacccugagcuuacgggacuggauuguauucgccccugcuucugggucgaacucaucagaggccggccuaaagagaacaccauuuggacauccgggagcucuaucuccuuuuguggagugaauagcgacaccguuggcuggucuuggcccgauggggccgagcugcccuucacaauugacaaguga

SEQ ID NO: 202517 - RNA, 1410 nt, Artificial Sequence; identical to SEQ ID NO: 201664
  derived and/or modified sequence opt5 from neuraminidase__InfluenzaA__ADM14711

SEQ ID NO: 202518 - RNA, 1410 nt, Artificial Sequence
  derived and/or modified sequence opt5 from neuraminidase__InfluenzaA__ADM14720
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcgucuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 202519 - RNA, 1410 nt, Artificial Sequence
  derived and/or modified sequence opt5 from neuraminidase__InfluenzaA__ADM14730
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuguuuacagcaaggacaacucuaucagaaucggguccaaaggagaugugcucgucauucgggagccguuuaucagcuguucuccccuggaaugccgcaccuucuuucuuacacagggcgcccugcucaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcugaccaucggcaucuccgggccugauaacggagcuguggccguccucaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccuugaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggagcggcuuugagaugauuugggauccuaauggguggaccggaaccgacaacaauuucuccaucaagcaagacaucgugggcauuaacgaauggucuggguacagcggcuccuuuguccagcaucccgagcugacaggacucgauuguauccgcccuugcuucuggguggaacugauuagaggccggcccaaagagaauacgaucuggaccagcgggucuuccauuagcuucuguggaguuaacucugacacagugggcugguccuggcccgauggggcugagcuuccuuuuaccaucgacaaguga

SEQ ID NO: 202520 - RNA, 1350 nt, Artificial Sequence
  derived and/or modified sequence opt5 from neuraminidase__InfluenzaA__ADM14748
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucugucggaccuuuuuccucacacagggggcccugcuuaaugauaaacauuccaacggaaccauuaaggaccgcagcccguauagaacgcugaugucuugccccaucggcgaggugccuucccccuacaacagccgguuugaaucugucgccugguccgcuagcgccugucacgauggcauuaauuggcucaccaucgggauuuccggaccugacaacggcgcuguggccguucugaaauauaaugggaucaucacagauaccauuaagucuuggcgcaacaauauccugagaacacaagagagcgaaugcgcgugugugaacggauccugcuucaccgucaugacggacggccccagcgaugggcaggccucuuacaagauuuuucggaucgagaaaggaaagauugugaaauccguggagaugaaugcuccuaacuaucauuacgaagaguguagcugcuacccggacucuagcgaaaucacaugugucugccgcgauaauuggcacggcuccaacagacccuggguuucuuucaaucagaaccucgaguaucagaucggcuacauuugcagcgggaucuuuggagacaauccucggcccaacgauaagaccggcuccugugggccugugagcucuaauggagccaacggcgugaaaggguucuccuuuaaguauggaaacggcgucuggauuggccgcacaaagagcaucucuuccagaaauggguucgagaugauuugggaccccaacggauggaccggcaccgauaauaacuuuagcaucaaacaagacauuguggggaucaaugaaugguccggauacucuggcagcuucguucagcauccggagcugacagggcuugacugcauccggccuuguuuuuggguggaacugauucgcggcagacccaaggagaacacgaucuggaccuccggaucuagcauuuccuucugcggcgucaauagcgauacagugggguggucuuggccugacggagcugaacuccccuucaccaucgauaaauga

SEQ ID NO: 202521 - RNA, 1410 nt, Artificial Sequence
  derived and/or modified sequence opt5 from neuraminidase__InfluenzaA__ADM14758
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagauuaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccaucgacaaguga

SEQ ID NO: 202522 - RNA, 1410 nt, Artificial Sequence; identical to SEQ ID NO: 202521
  derived and/or modified sequence opt5 from neuraminidase__InfluenzaA__ADM14767

SEQ ID NO: 202523 - RNA, 1410 nt, Artificial Sequence; identical to SEQ ID NO: 199762
  derived and/or modified sequence opt5 from neuraminidase__InfluenzaA__ADM14777

SEQ ID NO: 202524 - RNA, 1410 nt, Artificial Sequence; identical to SEQ ID NO: 199762
  derived and/or modified sequence opt5 from neuraminidase__InfluenzaA__ADM14814

SEQ ID NO: 202525 - RNA, 1410 nt, Artificial Sequence; identical to SEQ ID NO: 199762
  derived and/or modified sequence opt5 from neuraminidase__InfluenzaA__ADM14823

SEQ ID NO: 202526 - RNA, 1410 nt, Artificial Sequence; identical to SEQ ID NO: 201385
  derived and/or modified sequence opt5 from neuraminidase__InfluenzaA__ADM14841

SEQ ID NO: 202527 - RNA, 1410 nt, Artificial Sequence; identical to SEQ ID NO: 201385
  derived and/or modified sequence opt5 from neuraminidase__InfluenzaA__ADM14859

SEQ ID NO: 202528 - RNA, 1410 nt, Artificial Sequence; identical to SEQ ID NO: 200899
  derived and/or modified sequence opt5 from neuraminidase__InfluenzaA__ADM14868

SEQ ID NO: 202529 - RNA, 1410 nt, Artificial Sequence; identical to SEQ ID NO: 201385
  derived and/or modified sequence opt5 from neuraminidase__InfluenzaA__ADM14878

SEQ ID NO: 202530 - RNA, 1410 nt, Artificial Sequence; identical to SEQ ID NO: 199762
  derived and/or modified sequence opt5 from neuraminidase__InfluenzaA__ADM14887

SEQ ID NO: 202531 - RNA, 1410 nt, Artificial Sequence
  derived and/or modified sequence opt5 from neuraminidase__InfluenzaA__ADM14896
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagaugugcucgucauucgggagccguuuaucagcuguucuccccuggaaugccgcaccuucuuucuuacacagggcgcccugcucaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcugaccaucggcaucuccgggccugauaacggagcuguggccguccucaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccuugaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuuuguccagcaucccgagcugacaggacucgauuguauccgcccuugcuucuggguggaacugauuagaggccggcccaaagagaacacgaucuggaccuccgggagcucuauuuccuucuguggaguuaauagcgacacagugggcuggucuuggcccgauggggcugagcuuccuuuuaccaucgacaaguga

SEQ ID NO: 202532 - RNA, 1410 nt, Artificial Sequence; identical to SEQ ID NO: 199762
  derived and/or modified sequence opt5 from neuraminidase__InfluenzaA__ADM14905

SEQ ID NO: 202533 - RNA, 1410 nt, Artificial Sequence; identical to SEQ ID NO: 199762
  derived and/or modified sequence opt5 from neuraminidase__InfluenzaA__ADM14923

SEQ ID NO: 202534 - RNA, 1410 nt, Artificial Sequence; identical to SEQ ID NO: 201050
  derived and/or modified sequence opt5 from neuraminidase__InfluenzaA__ADM14932

SEQ ID NO: 202535 - RNA, 1410 nt, Artificial Sequence; identical to SEQ ID NO: 199762
  derived and/or modified sequence opt5 from neuraminidase__InfluenzaA__ADM14950

SEQ ID NO: 202536 - RNA, 1410 nt, Artificial Sequence; identical to SEQ ID NO: 200780
  derived and/or modified sequence opt5 from neuraminidase__InfluenzaA__ADM14959

SEQ ID NO: 202537 - RNA, 1410 nt, Artificial Sequence
  derived and/or modified sequence opt5 from neuraminidase__InfluenzaA__ADM14977
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcgugagaaucgggucuaaaggagaugucuuugugauccgggagccguucauuuccuguagcccccucgaaugccgcaccuuuuuccugacacagggcgcccuucugaacgacaagcauucuaacggcaccaucaaagauagauccccuuaucggacgcucaugagcugucccauuggggagguuccuucucccuacaauucccgcuuugaaagcguggccugguccgcuucugccugccacgacggaaucaacuggcugaccauuggcaucagcgggccugauaauggagcugucgccgugcugaaguauaacggcaucauuacagacaccaucaaguccuggagaaauaacauucuccggacacaagagagcgagugugcgugcgugaaugggucuuguuucaccgucaugacggauggaccguccaacggccaggccagcuacaaaaucuuucgcauugaaaagggcaaaaucguuaagucuguggagaugaaugcucccaacuaucauuacgaagagugcagcuguuacccugacuccucugagaucacaugcgugugcagagauaauuggcacgggagcaaccggcccugggucuccuucaaucagaaccuggaauaucagauuggauacaucuguagcggcauuuuuggggacaauccucgccccaacgauaaaaccggaucuugcggcccgguguccagcaacggggccaauggaguuaagggcuucucuuuuaaguauggcaacgggguguggaucggaagaacaaaauccauuagcucccggaauggcuucgagaugaucugggacccuaacggguggaccggaaccgauaauaacuuuucuauuaagcaagacaucgucggcaucaaugaauggagcggguacuccggcucuuucgugcagcaucccgagcuuacaggacuggacuguauucgcccuugcuucuggguugaacucaucagaggccggcccaaagagaacacgauuuggaccagcggguccagcaucucuuuuuguggagucaauuccgauacagugggcuggagcuggcccgacggggcugagcugccuuucaccauugauaaguga

SEQ ID NO: 202538 - RNA, 1410 nt, Artificial Sequence; identical to SEQ ID NO: 201385
  derived and/or modified sequence opt5 from neuraminidase__InfluenzaA__ADM14987

SEQ ID NO: 202539 - RNA, 1410 nt, Artificial Sequence; identical to SEQ ID NO: 200929
  derived and/or modified sequence opt5 from neuraminidase__InfluenzaA__ADM26787

SEQ ID NO: 202540 - RNA, 1410 nt, Artificial Sequence; identical to SEQ ID NO: 201508
  derived and/or modified sequence opt5 from neuraminidase__InfluenzaA__ADM26798

SEQ ID NO: 202541 - RNA, 1410 nt, Artificial Sequence
  derived and/or modified sequence opt5 from neuraminidase__InfluenzaA__ADM26809
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacagugaauaacguucauagcaauaacaccgugcgggaucgcacgccguauagaacacugcucaugaaugaacugggcguccccuuucaccuggggaccaaacaggugugcauugccugguccucuagcuccugucaugacggaaaggccuggcuccacguuugcaucacaggcgaugacaagaacgcuaccgccagcuucauuuacaauggccggcugguggauucugucguguccuggagcaaagagauccuucgcacccaggaaucugagugugugugcauuaacgggacauguacggucguuaugaccgacggauccgcuagcggcaaggccgauacaaaaauccuguuuaucgaggaagggaagauugugcauaccuccacacucucuggaagcgcgcaacacguggaggaaugcuccugcuauccuagauaccccggcguccggugugugugccgcgacaacuggaaggggagcaauagaccuaucguugauauuaacaucaaagaccacucuauuguguccagcuacgucuguucuggacuggugggcgacacgccccggaagaaugauagcuccucuagcucccauugccuugacccgaacaaugaggaaggcgggcacggaguuaaaggcugggccuucgaugacgggaacgauguguggaugggacgcaccaucagcgagaagucuagacugggcuaugagacauuuaaagucaucgaagggugguccaaucauaagagcaaacuccagauuaaccgccaggugaucgucgaccggggaaauagaucuggcuacuccggcauuuucagcguggaggggaaguccuguaucaaccggugcuuuuauguugaacugauuagaggacgcaaggaggaaaccgaggugcuguggaccucuaauagcaucgucguguucuguggcacauccgggaccuacggaacaggcucuuggccugauggggcugaccucaaccugaugcccauuuga

SEQ ID NO: 202542 - RNA, 1410 nt, Artificial Sequence
  derived and/or modified sequence opt5 from neuraminidase__InfluenzaA__ADM26820
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucucuggacauccaacucuaucguggucuucuguggcaccagcgggacauacggaacgggcuccuggcccgauggggcugaccugaaucuuaugccuauuuga

SEQ ID NO: 202543 - RNA, 1350 nt, Artificial Sequence
  derived and/or modified sequence opt5 from neuraminidase__InfluenzaA__ADM31427
augaaccccaaucagaagaucauuaccaucggcagcgugugcaugauuaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgauccggggaugggcuguccacucuaaagacaacagcauucgcaucggcuccaagggggauguguuuguuauuagagagcccuucaucagcugcucucauauggaaugucggaccuuuuuccucacacaaggagcccugcuuaaugacaaacacuccaacggcaccgugaaggaucgcagcccucauagaacacugaugucuugccccgucggcgaggccccuucccccuacaauagccgguuugaaucuguggcuugguccgccagcgcuugucacgacgggaucuccuggcucaccauuggaaucucuggcccugauaacggggccguugcggugcugaaauauaauggaauuaucacggacaccauuaagagcuggggcaacaauauccugcgcacacaggaguccgagugcgccugugucaacgggagcugcuucaccgugaugacagauggaccgucuaacggccaggcuuccuacaagaucuuuaaaauugaaaagggcaaaguggucaagagcguugagcucaaugcccccaacuaucacuacgaagaguguucuugcuauccugacagcggggagaucauuugugugugcagagauaauuggcauggauccaaccggcccugggugucuuucaaucagaaccuggaauaccaaaucggcuauauuugcagcggggucuuuggagacaauccucgccccaacgauggcaccggguccuguggaccgaugagcccuaauggcgcuuacggcaucaaaggguucucuuuuaaguacggaaacggcguguggaucgggagaacgaaguccacaaauagccggucuggauucgagaugauuugggaccccaacggcuggaccgggacagauuccgaauuuagcguuaaacaggacaucguggccauuaccgacugguccggcuauucuggcagcuucguccagcacccugagcuuaccggacuggauugcauccgccccuguuucuggguggaacucauuagagggcggcccaaggaguccacaaucuggacgucuggaagcuccauuagcuuuugcggcguuaauucugacaccguguccuggagcuggccugauggggcggagcugccguucacaaucgacaaauga

SEQ ID NO: 202544 - RNA, 1410 nt, Artificial Sequence
  derived and/or modified sequence opt5 from neuraminidase__InfluenzaA__ADM31481
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaagggagcuguggccguccugaaguauaacggcauuaucacagacaccauuaaaagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaauggagugaagggcuucuccuuuaaauauggcaacgggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 202545 - RNA, 1410 nt, Artificial Sequence; identical to SEQ ID NO: 200345
  derived and/or modified sequence opt5 from neuraminidase__InfluenzaA__ADM31491

SEQ ID NO: 202546 - RNA, 1410 nt, Artificial Sequence; identical to SEQ ID NO: 201967
  derived and/or modified sequence opt5 from neuraminidase__InfluenzaA__ADM31501

SEQ ID NO: 202547 - RNA, 1410 nt, Artificial Sequence; identical to SEQ ID NO: 199762
  derived and/or modified sequence opt5 from neuraminidase__InfluenzaA__ADM31511

SEQ ID NO: 202548 - RNA, 1410 nt, Artificial Sequence; identical to SEQ ID NO: 201963
  derived and/or modified sequence opt5 from neuraminidase__InfluenzaA__ADM31521

SEQ ID NO: 202549 - RNA, 1410 nt, Artificial Sequence; identical to SEQ ID NO: 199762
  derived and/or modified sequence opt5 from neuraminidase__InfluenzaA__ADM31531

SEQ ID NO: 202550 - RNA, 1410 nt, Artificial Sequence; identical to SEQ ID NO: 201050
  derived and/or modified sequence opt5 from neuraminidase__InfluenzaA__ADM31541

SEQ ID NO: 202551 - RNA, 1410 nt, Artificial Sequence; identical to SEQ ID NO: 199762
  derived and/or modified sequence opt5 from neuraminidase__InfluenzaA__ADM31551

SEQ ID NO: 202552 - RNA, 1410 nt, Artificial Sequence; identical to SEQ ID NO: 199762
  derived and/or modified sequence opt5 from neuraminidase__InfluenzaA__ADM31561

SEQ ID NO: 202553 - RNA, 1410 nt, Artificial Sequence; identical to SEQ ID NO: 199762
  derived and/or modified sequence opt5 from neuraminidase__InfluenzaA__ADM31571

SEQ ID NO: 202554 - RNA, 1410 nt, Artificial Sequence; identical to SEQ ID NO: 200939
  derived and/or modified sequence opt5 from neuraminidase__InfluenzaA__ADM31581

SEQ ID NO: 202555 - RNA, 1410 nt, Artificial Sequence; identical to SEQ ID NO: 199762
  derived and/or modified sequence opt5 from neuraminidase__InfluenzaA__ADM31601

SEQ ID NO: 202556 - RNA, 1410 nt, Artificial Sequence; identical to SEQ ID NO: 201050
  derived and/or modified sequence opt5 from neuraminidase__InfluenzaA__ADM31611

SEQ ID NO: 202557 - RNA, 1410 nt, Artificial Sequence
  derived and/or modified sequence opt5 from neuraminidase__InfluenzaA__ADM31621
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuucccucgaaugccgcaccuuuuuccugacacagggcgcccuucugaaugacaagcauagcaacggcaccauuaaagauagaucucccuaucggacgcucauguccuguccuaucggggaggugcccagcccuuacaacucccgcuuugaaucuguugccuggagcgcuuccgccugccacgacggaauuaauuggcugaccaucggcaucagcgggcccgauaacggagcuguggccguccugaaguauaauggcauuaucacagacaccauuaagucuuggagaaacaauauccuccggacacaagaguccgagugugcgugcgugaacgggagcuguuucaccgugaugacggauggaccuucugacggccaggccagcuacaaaauuuuucgcaucgaaaagggcaaaaucgucaaguccguugagaugaaugcuccgaacuaucauuacgaagagugcucuuguuaccccgauagcuccgagauuacaugcgugugcagagacaauuggcacgggagcaaccggccuugggugucuuucaaucagaaccuggaauaucagaucggauacauuuguuccggcaucuuuggggauaauccccgcccuaacgacaaaaccggaagcugcggccccgucucuuccaauggggccaacggagugaagggcuucagcuuuaaguauggcaacgggguuuggauuggaagaacaaaauccaucucuagccggaauggcuucgagaugauuugggauccgaacggguggaccggaaccgacaauaacuuuuccaucaagcaagacaucgugggcauuaaugaauggucuggguacagcggcuccuucguccagcauccugagcuuacaggacuggauuguauccgccccugcuucuggguggaacucauuagaggccggccuaaagagaacacgaucuggaccagcgggucuuccauuagcuuuuguggaguuaauucugacacagugggcugguccuggcccgauggggcugagcugcccuucaccaucgacaaguga

SEQ ID NO: 202558 - RNA, 1410 nt, Artificial Sequence; identical to SEQ ID NO: 201050
  derived and/or modified sequence opt5 from neuraminidase__InfluenzaA__ADM31631

SEQ ID NO: 202559 - RNA, 1410 nt, Artificial Sequence; identical to SEQ ID NO: 200939
  derived and/or modified sequence opt5 from neuraminidase__InfluenzaA__ADM31641

SEQ ID NO: 202560 - RNA, 1410 nt, Artificial Sequence; identical to SEQ ID NO: 201224
  derived and/or modified sequence opt5 from neuraminidase__InfluenzaA__ADM31651

SEQ ID NO: 202561 - RNA, 1410 nt, Artificial Sequence; identical to SEQ ID NO: 200939
  derived and/or modified sequence opt5 from neuraminidase__InfluenzaA__ADM31661

SEQ ID NO: 202562 - RNA, 1410 nt, Artificial Sequence
  derived and/or modified sequence opt5 from neuraminidase__InfluenzaA__ADM31671
augaaccccaaucagaagaucauuaccaucggcagcgugugcaugacaauugggauggccaaccugauccuccaaauuggaaauaucaucuccauuuggaucucucacagcacgcagcugggcaaccagaaucagauugagaccuguaaccaauccgucaucacauacgaaaauaacaccuggguuaaucagacauaugugaacauuucuaauaccaacuucgcugccgggcagagcguggucuccgcgaaacuugcuggaaauucuagccugugcccuguguccggcugggccaucuacagcaaggacaacucuauuagaaucggguccaaaggagauguuuuugugauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggucccuucccccuacaacagccgcuuugaauccguggcuuggucugccagcgcuugccacgacggaaucaauuggcugacaauuggcaucuccgggccugauaacggagccguugcggugcugaaguauaauggcaucauuaccgacacaaucaagagcuggagaaacaauauucuccggacccaagagucugagugugccugcgucaacggguccuguuucacggugaugacagauggaccgagcgacggccaggcuucuuacaaaaucuuucgcauugaaaagggcaaaaucgucaagagcguggagaugaaugcccccaacuaucauuacgaagagugcuccuguuacccugauucuagcgagauuaccugcguuugcagagacaauuggcacggguccaaccggcccugggugagcuucaaucagaaccuggaauaucagaucggauacaucuguucuggcauuuuuggggauaauccucgccccaacgacaaaacaggauccugcggcccggugagcucuaauggggcuaacggagucaagggcuucuccuuuaaguauggcaacgggguguggaucggaagaaccaaaagcauuuccucucggaauggcuucgagaugaucugggauccuaacggguggaccggaacagacaauaacuuuagcauuaagcaagacaucguuggcaucaaugaaugguccggguacucuggcagcuucgugcagcaucccgagcuuacgggacuggauuguauucgcccuugcuucugggucgaacucaucagaggccggcccaaagagaacaccauuuggacauccgggagcucuaucuccuuuuguggagugaauagcgacaccguuggcuggucuuggcccgauggggccgagcugccuuucacaauugacaaguga

SEQ ID NO: 202563 - RNA, 1410 nt, Artificial Sequence; identical to SEQ ID NO: 201050
  derived and/or modified sequence opt5 from neuraminidase__InfluenzaA__ADM31681

SEQ ID NO: 202564 - RNA, 1410 nt, Artificial Sequence
  derived and/or modified sequence opt5 from neuraminidase__InfluenzaA__ADM31691
augaaccccaaucagaagauccugaccauuggcagcgugugcaugacaaucgggauggccaaccucauucugcaaaucggaaauauuaucuccaucuggauuucucacagcauccagcuuggcaaccagaaucagacggagaccuguaaccaauccgucauuacauacgaaaauaacaccuggguuaaucagacauaugugaacaucucuaauaccaacuucgcugccgggcagagcguggucuccgugaaacuggcgggaaauucuagccucugcccuguuuccggcugggcuauuuacagcaaggacaacucuaucagaauuggguccaaaggagauguguuugucauccgggagccguucaucagcuguucuccccuggaaugccgcacauuuuuccuuacccagggcgcccugcucaaugacaagcauuccaacggcacgauuaaagauagaagcccuuaucggacccugaugucuugucccaucggggaggugccuucccccuacaacagccgcuuugaauccguugccuggucugcuagcgccugccacgacggaauuaauuggcugacaaucggcauuuccgggccugauaacggagcuguggccguccucaaguauaauggcaucaucaccgacacaauuaagagcuggagaaacaauauccugcggacccaagagucugagugugcgugcgugaacggguccuguuucacggugaugacagauggaccgagcgacggccaggccucuuacaaaauuuuucgcaucgaaaagggcaaaauugucaagagcguugagaugaaugcucccaacuaucauuacgaagagugcuccuguuacccugauucuagcgagauuaccugcgugugcagagacaauuggcacggguccaaccggcccugggugagcuucaaucagaaccuugaauaucagaucggauacaucuguucuggcaucuuuggggauaauccucgccccaacgacaaaacaggauccugcggcccggucagcucuaauggggccaacggagugaagggcuucuccuuuaaguauggcaacgggguuuggauuggaagaaccaaaagcaucuccucucggaauggcuucgagaugauuugggauccuaacggguggaccggaacagacaauaacuuuagcaucaagcaagacauugugggcaucaaugaaugguccggguacucuggcagcuucguccagcaucccgagcugacgggacucgauuguauccgcccuugcuucuggguggaacugauuagaggccggcccaaagagaacaccaucuggacauccgggagcucuauuuccuuuuguggaguuaauagcgacaccgugggcuggucuuggcccgauggggcugagcuuccuuucacaaucgacaaguga

SEQ ID NO: 202565 - RNA, 1410 nt, Artificial Sequence; identical to SEQ ID NO: 199762
  derived and/or modified sequence opt5 from neuraminidase__InfluenzaA__ADM31701

SEQ ID NO: 202566 - RNA, 1410 nt, Artificial Sequence; identical to SEQ ID NO: 199762
  derived and/or modified sequence opt5 from neuraminidase__InfluenzaA__ADM31711

SEQ ID NO: 202567 - RNA, 1410 nt, Artificial Sequence; identical to SEQ ID NO: 201050
  derived and/or modified sequence opt5 from neuraminidase__InfluenzaA__ADM31721

SEQ ID NO: 202568 - RNA, 1410 nt, Artificial Sequence
  derived and/or modified sequence opt5 from neuraminidase__InfluenzaA__ADM31731
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcagaauugucaaaagcguugagaugaaugcucccaacuaucauuacgaagagugcuccuguuacccugauucuagcgagaucacgugcgugugccgggacaauuggcacggguccaaccgccccugggugagcuucaaucagaaccuggaauaucagauuggauacaucuguucuggcauuuuuggggauaauccuagacccaacgacaagacaggauccugcggcccggucagcucuaauggggccaacggagugaaaggcuucuccuuuaaguauggcaacgggguuuggaucggacggaccaagagcauuuccucucgcaauggcuucgagaugaucugggauccuaacggguggacaggaaccgacaauaacuuuagcaucaaacaagacauugugggcaucaaugaaugguccggguacucuggcagcuucguccagcaucccgagcuuaccggacuggauuguauuagaccuugcuucuggguggaacucauccggggccgccccaaggagaacacaauuuggacguccgggagcucuaucuccuuuuguggaguuaauagcgacaccgugggcuggucuuggcccgauggggcugagcugccuuucacaaucgacaaauga

SEQ ID NO: 202569 - RNA, 1410 nt, Artificial Sequence; identical to SEQ ID NO: 202137
  derived and/or modified sequence opt5 from neuraminidase__InfluenzaA__ADM31741

SEQ ID NO: 202570 - RNA, 1410 nt, Artificial Sequence; identical to SEQ ID NO: 199762
  derived and/or modified sequence opt5 from neuraminidase__InfluenzaA__ADM31751

SEQ ID NO: 202571 - RNA, 1410 nt, Artificial Sequence
  derived and/or modified sequence opt5 from neuraminidase__InfluenzaA__ADM31761
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucauaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaaguuuagcaucaaacaggacaucgugggcauuuccgaauggucuggguacagcggcuccuucguccaacaccccgagcuuacaggacuggauuguauccgcccuugcuucuggguggaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 202572 - RNA, 1410 nt, Artificial Sequence
  derived and/or modified sequence opt5 from neuraminidase__InfluenzaA__ADM31771
augaaccccaaucagaagauccugaccauuggcagcgugugcaugacaaucgggauggccaaccucauucugcaaaucggaaauauuaucuccaucuggauuucucacagcauccagcuuggcaaccagaaucagacggagaccuguaaccaauccgucauuaucuacgaaaauaacacauggguuaaucagaccuaugugaacauuucuaauacaaacuucgcugccgggcagagcguggucuccgugaaacuggcgggaaauucuagccucugcccuguuuccggcugggcuaucuacagcaaggacaacucuauuagaaucggguccaaaggagauguguuugucauccgggagccguucauuagcuguucuccccuggaaugccgcaccuuuuuccuuacacagggcgcccugcucaaugacaagcauuccaacggcaccaucaaagauagaagcccuuaucggacgcugaugucuugucccauuggggaggugccuucccccuacaacagccgcuuugaauccguugccuggucugcuagcgccugccacgacggaaucaauuggcugaccauuggcaucuccgggccugauaacggagcuguggccguccucaaguauaauggcaucauuacagacaccaucaagagcuggagaaacaauauucugcggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuugaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcugacaggacucgauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcuuccuuucaccauugacaaguga

SEQ ID NO: 202573 - RNA, 1410 nt, Artificial Sequence
  derived and/or modified sequence opt5 from neuraminidase__InfluenzaA__ADM31801
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucaauaacacaaauuucgcugccgggcagucuguggucagcgugaaacuugcgggaaacuccucucugugcccuguuagcggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaaguuuucuaucaaacaagacaucgugggcauuaaugaauggagcggguacuccggcucuuucguccagcaucccgagcuuacaggacuggauuguauccgcccuugcuucuggguggaacucauuagaggccggcccaaggagaacacgaucuggaccagcggguccagcauuucuuuuuguggaguuaauuccgacacagugggcuggagcuggcccgauggggcugagcugccuuucaccaucgacaaauga

SEQ ID NO: 202574 - RNA, 1410 nt, Artificial Sequence
  derived and/or modified sequence opt5 from neuraminidase__InfluenzaA__ADM31811
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaauuugcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaaguucagcaucaaacaagacaucgugggcauuaacgaaugguccggguacucuggcagcuucguccagcaucccgagcugacaggacuugauuguauccgcccuugcuuuuggguggaacugauuagaggccggcccaaggagaauacgaucuggaccuccgggagcucuauuuccuucuguggaguuaacagcgacacagugggcuggucuuggcccgauggggcugagcucccuuuuaccaucgacaaauga

SEQ ID NO: 202575 - RNA, 1410 nt, Artificial Sequence; identical to SEQ ID NO: 200939
  derived and/or modified sequence opt5 from neuraminidase__InfluenzaA__ADM31821

SEQ ID NO: 202576 - RNA, 1410 nt, Artificial Sequence; identical to SEQ ID NO: 199762
  derived and/or modified sequence opt5 from neuraminidase__InfluenzaA__ADM31831

SEQ ID NO: 202577 - RNA, 1410 nt, Artificial Sequence; identical to SEQ ID NO: 199762
  derived and/or modified sequence opt5 from neuraminidase__InfluenzaA__ADM31841

SEQ ID NO: 202578 - RNA, 1410 nt, Artificial Sequence
  derived and/or modified sequence opt5 from neuraminidase__InfluenzaA__ADM31851
augaaccccaaucagaagauccugaccauuggcagcgugugcaugacaaucgggauggccaaccucauucugcaaaucggaaauauuaucuccaucuggauuucucacagcauccagcuuggcaaccagaaucagacggagaccuguaaccaauccgucauuacauacgaaaauaacaccuggguuaaucagacauaugugaacaucucuaauaccaacuucgcugccgggcagagcguggucuccgugaaacuggcgggaaauucuagccucugcccuguuuccggcugggcuauuuacagcaaggacaacucuaucagaauuggguccaaaggagauguguuugucauccgggagccguucaucagcuguucuccccuggaaugccgcacauuuuuccuuacccagggcgcccugcucaaugacaagcauuccaacggcacgauuaaagauagaagcccuuaucggacccugaugucuugucccaucggggaggugccuucccccuacaacagccgcuuugaauccguugccuggucugcuagcgccugccacgacggaauuaauuggcugacaaucggcauuuccgggccugauaacggagcuguggccguccucaaguauaauggcaucaucaccgacacaauuaagagcuggagaaacaauauccugcggacccaagagucugagugugcgugcgugaacggguccuguuucacggugaugacagauggaccgagcgacggccaggccucuuacaaaauuuuucgcaucgaaagaggcaagauugucaaaagcguugagaugaaugcucccaacuaucauuacgaagagugcuccuguuacccugauucuagcgagauuaccugcgugugccgggacaauuggcacggguccaaccgccccugggugagcuucaaucagaaccuugaauaucagaucggauacaucuguucuggcaucuuuggggauaauccuagacccaacgacaagacaggauccugcggcccggucagcucuaauggggccaacggagugaaaggcuucuccuuuaaguauggcaacgggguuuggauuggacggaccaagagcaucuccucucgcaauggcuucgagaugauuugggauccuaacggguggaccggaacagacaauaacuuuagcaucaaacaagacauugugggcaucaaugaaugguccggguacucuggcagcuucguccagcaucccgagcugacgggacucgauuguaucagaccuugcuucuggguggaacugauucggggccgccccaaggagaacaccaucuggacauccgggagcucuauuuccuuuuguggaguuaauagcgacaccgugggcuggucuuggcccgauggggcugagcuuccuuucacaaucgacaaauga

SEQ ID NO: 202579 - RNA, 1410 nt, Artificial Sequence; identical to SEQ ID NO: 199762
  derived and/or modified sequence opt5 from neuraminidase__InfluenzaA__ADM31861

SEQ ID NO: 202580 - RNA, 1410 nt, Artificial Sequence; identical to SEQ ID NO: 199762
  derived and/or modified sequence opt5 from neuraminidase__InfluenzaA__ADM31871

SEQ ID NO: 202581 - RNA, 1410 nt, Artificial Sequence
  derived and/or modified sequence opt5 from neuraminidase__InfluenzaA__ADM31881
augaaccccaaucagaagaucauuaccaucggcagcgugugcaugacaauugggauggccaaccugauccuccaaauuggaaauacgaucuccaucuggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 202582 - RNA, 1410 nt, Artificial Sequence; identical to SEQ ID NO: 199762
  derived and/or modified sequence opt5 from neuraminidase__InfluenzaA__ADM31891

SEQ ID NO: 202583 - RNA, 1410 nt, Artificial Sequence; identical to SEQ ID NO: 199752
  derived and/or modified sequence opt5 from neuraminidase__InfluenzaA__ADM31901

SEQ ID NO: 202584 - RNA, 1410 nt, Artificial Sequence; identical to SEQ ID NO: 200985
  derived and/or modified sequence opt5 from neuraminidase__InfluenzaA__ADM31911

SEQ ID NO: 202585 - RNA, 1410 nt, Artificial Sequence; identical to SEQ ID NO: 200985
  derived and/or modified sequence opt5 from neuraminidase__InfluenzaA__ADM31921

SEQ ID NO: 202586 - RNA, 1410 nt, Artificial Sequence; identical to SEQ ID NO: 201443
  derived and/or modified sequence opt5 from neuraminidase__InfluenzaA__ADM31931

SEQ ID NO: 202587 - RNA, 1410 nt, Artificial Sequence; identical to SEQ ID NO: 199752
  derived and/or modified sequence opt5 from neuraminidase__InfluenzaA__ADM31941

SEQ ID NO: 202588 - RNA, 1410 nt, Artificial Sequence; identical to SEQ ID NO: 201443
  derived and/or modified sequence opt5 from neuraminidase__InfluenzaA__ADM31951

SEQ ID NO: 202589 - RNA, 1410 nt, Artificial Sequence
  derived and/or modified sequence opt5 from neuraminidase__InfluenzaA__ADM31961
augaaccccaaucagaagaucauuaccaucggcagcgugugcauggccauugggauggcuaaccugauccuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgccgcggggcagagcguggucuccgugaaacuugcuggaaauucuagccugugcccuguuuccggcugggccauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugcuuggucugccagcgcuugccacgacggaauuaauuggcugacgaucggcaucuccgggccugauaacggagccguggcgguccugaaguauaauggcauuaucaccgacacaauuaagagcuggagaaacaauauccuccggacccaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaccgacaauaacuuuagcaucaagcaagacaucgugggcauuaaugaaugguccggguacucuggcagcuucguccagcaucccgagcuuaccggacuggauuguauccgcccuugcuucuggguggaacucauuagaggccggcccaaagagaacacaaucuggacguccgggagcucuauuuccuuuuguggaguuaauagcgacaccgugggcuggucuuggcccgauggggccgagcugccuuucacaaucgacaaguga

SEQ ID NO: 202590 - RNA, 1410 nt, Artificial Sequence
  derived and/or modified sequence opt5 from neuraminidase__InfluenzaA__ADM31971
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccaugaaacuugcgggaaauucuagccugugcccuguguccggcugggcuauuuacagcaaggacaacucuguuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcgugaucacagacaccauuaagagcuggagaaacaauauccuccggacacaagagucugagugugcgugcgugaacggguccuguuucaccgucaugacggauggaccgagcaauggccaggccucuuacaaaauuuuucgcaucgaaaagggcaaaauuguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagaucggauacauuuguucuggcaucuuuggggacaacccucgccccaaugauaaaaccggauccugcggcccggugagcucuaacggggccaacggaguuaagggcuucuccuuuaaguauggcaaugggguguggauuggaagaacaaaaagcaucuccucucggaacggcuucgagaugauuugggacccuaauggguggaccggaaccgauaacaauuuuagcaucaagcaagacauugucggcaucaacgaaugguccggguacucuggcagcuucgugcagcaucccgagcuuacaggacuggacuguauccgcccuugcuucuggguugaacucauuagaggccggcccaaagagaauacgaucuggaccuccgggagcucuauuuccuuuuguggagugaacagcgauacagucggcuggucuuggcccgacggggcugagcugccuuucaccaucgauaaguga

SEQ ID NO: 202591 - RNA, 1410 nt, Artificial Sequence; identical to SEQ ID NO: 200985
  derived and/or modified sequence opt5 from neuraminidase__InfluenzaA__ADM31981

SEQ ID NO: 202592 - RNA, 1410 nt, Artificial Sequence; identical to SEQ ID NO: 199752
  derived and/or modified sequence opt5 from neuraminidase__InfluenzaA__ADM31991

SEQ ID NO: 202593 - RNA, 1410 nt, Artificial Sequence; identical to SEQ ID NO: 199752
  derived and/or modified sequence opt5 from neuraminidase__InfluenzaA__ADM32001

SEQ ID NO: 202594 - RNA, 1410 nt, Artificial Sequence; identical to SEQ ID NO: 199752
  derived and/or modified sequence opt5 from neuraminidase__InfluenzaA__ADM32011

SEQ ID NO: 202595 - RNA, 1410 nt, Artificial Sequence; identical to SEQ ID NO: 199762
  derived and/or modified sequence opt5 from neuraminidase__InfluenzaA__ADM32021

SEQ ID NO: 202596 - RNA, 1410 nt, Artificial Sequence; identical to SEQ ID NO: 200732
  derived and/or modified sequence opt5 from neuraminidase__InfluenzaA__ADM32031

SEQ ID NO: 202597 - RNA, 1410 nt, Artificial Sequence; identical to SEQ ID NO: 201486
  derived and/or modified sequence opt5 from neuraminidase__InfluenzaA__ADM32051

SEQ ID NO: 202598 - RNA, 1410 nt, Artificial Sequence; identical to SEQ ID NO: 199762
  derived and/or modified sequence opt5 from neuraminidase__InfluenzaA__ADM32061

SEQ ID NO: 202599 - RNA, 1410 nt, Artificial Sequence; identical to SEQ ID NO: 199762
  derived and/or modified sequence opt5 from neuraminidase__InfluenzaA__ADM32071

SEQ ID NO: 202600 - RNA, 1410 nt, Artificial Sequence; identical to SEQ ID NO: 199762
  derived and/or modified sequence opt5 from neuraminidase__InfluenzaA__ADM32081

SEQ ID NO: 202601 - RNA, 1410 nt, Artificial Sequence; identical to SEQ ID NO: 200985
  derived and/or modified sequence opt5 from neuraminidase__InfluenzaA__ADM32091

SEQ ID NO: 202602 - RNA, 1410 nt, Artificial Sequence; identical to SEQ ID NO: 199762
  derived and/or modified sequence opt5 from neuraminidase__InfluenzaA__ADM32101

SEQ ID NO: 202603 - RNA, 1410 nt, Artificial Sequence; identical to SEQ ID NO: 199762
  derived and/or modified sequence opt5 from neuraminidase__InfluenzaA__ADM32111

SEQ ID NO: 202604 - RNA, 1410 nt, Artificial Sequence; identical to SEQ ID NO: 201443
  derived and/or modified sequence opt5 from neuraminidase__InfluenzaA__ADM32554

SEQ ID NO: 202605 - RNA, 1410 nt, Artificial Sequence; identical to SEQ ID NO: 199752
  derived and/or modified sequence opt5 from neuraminidase__InfluenzaA__ADM32564

SEQ ID NO: 202606 - RNA, 1410 nt, Artificial Sequence; identical to SEQ ID NO: 200985
  derived and/or modified sequence opt5 from neuraminidase__InfluenzaA__ADM32574

SEQ ID NO: 202607 - RNA, 1410 nt, Artificial Sequence; identical to SEQ ID NO: 199762
  derived and/or modified sequence opt5 from neuraminidase__InfluenzaA__ADM32584

SEQ ID NO: 202608 - RNA, 1410 nt, Artificial Sequence; identical to SEQ ID NO: 201443
  derived and/or modified sequence opt5 from neuraminidase__InfluenzaA__ADM32594

SEQ ID NO: 202609 - RNA, 1410 nt, Artificial Sequence; identical to SEQ ID NO: 199762
  derived and/or modified sequence opt5 from neuraminidase__InfluenzaA__ADM32604

SEQ ID NO: 202610 - RNA, 1410 nt, Artificial Sequence; identical to SEQ ID NO: 199762
  derived and/or modified sequence opt5 from neuraminidase__InfluenzaA__ADM32614

SEQ ID NO: 202611 - RNA, 1410 nt, Artificial Sequence; identical to SEQ ID NO: 199762
  derived and/or modified sequence opt5 from neuraminidase__InfluenzaA__ADM32624

SEQ ID NO: 202612 - RNA, 1410 nt, Artificial Sequence; identical to SEQ ID NO: 201443
  derived and/or modified sequence opt5 from neuraminidase__InfluenzaA__ADM32634

SEQ ID NO: 202613 - RNA, 1410 nt, Artificial Sequence; identical to SEQ ID NO: 199762
  derived and/or modified sequence opt5 from neuraminidase__InfluenzaA__ADM32644

SEQ ID NO: 202614 - RNA, 1410 nt, Artificial Sequence; identical to SEQ ID NO: 199762
  derived and/or modified sequence opt5 from neuraminidase__InfluenzaA__ADM32664

SEQ ID NO: 202615 - RNA, 1410 nt, Artificial Sequence; identical to SEQ ID NO: 200985
  derived and/or modified sequence opt5 from neuraminidase__InfluenzaA__ADM32674

SEQ ID NO: 202616 - RNA, 1410 nt, Artificial Sequence; identical to SEQ ID NO: 199762
  derived and/or modified sequence opt5 from neuraminidase__InfluenzaA__ADM32684

SEQ ID NO: 202617 - RNA, 1410 nt, Artificial Sequence; identical to SEQ ID NO: 199752
  derived and/or modified sequence opt5 from neuraminidase__InfluenzaA__ADM32694

SEQ ID NO: 202618 - RNA, 1410 nt, Artificial Sequence; identical to SEQ ID NO: 199762
  derived and/or modified sequence opt5 from neuraminidase__InfluenzaA__ADM32704

SEQ ID NO: 202619 - RNA, 1410 nt, Artificial Sequence; identical to SEQ ID NO: 201486
  derived and/or modified sequence opt5 from neuraminidase__InfluenzaA__ADM32714

SEQ ID NO: 202620 - RNA, 1410 nt, Artificial Sequence; identical to SEQ ID NO: 201486
  derived and/or modified sequence opt5 from neuraminidase__InfluenzaA__ADM32724

SEQ ID NO: 202621 - RNA, 1410 nt, Artificial Sequence; identical to SEQ ID NO: 199762
  derived and/or modified sequence opt5 from neuraminidase__InfluenzaA__ADM32734

SEQ ID NO: 202622 - RNA, 1410 nt, Artificial Sequence; identical to SEQ ID NO: 200985
  derived and/or modified sequence opt5 from neuraminidase__InfluenzaA__ADM32744

SEQ ID NO: 202623 - RNA, 1410 nt, Artificial Sequence; identical to SEQ ID NO: 201486
  derived and/or modified sequence opt5 from neuraminidase__InfluenzaA__ADM32754

SEQ ID NO: 202624 - RNA, 1410 nt, Artificial Sequence; identical to SEQ ID NO: 200985
  derived and/or modified sequence opt5 from neuraminidase__InfluenzaA__ADM32764

SEQ ID NO: 202625 - RNA, 1410 nt, Artificial Sequence
  derived and/or modified sequence opt5 from neuraminidase__InfluenzaA__ADM32774
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucacgaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 202626 - RNA, 1410 nt, Artificial Sequence; identical to SEQ ID NO: 200732
  derived and/or modified sequence opt5 from neuraminidase__InfluenzaA__ADM32784

SEQ ID NO: 202627 - RNA, 1410 nt, Artificial Sequence; identical to SEQ ID NO: 200985
  derived and/or modified sequence opt5 from neuraminidase__InfluenzaA__ADM32794

SEQ ID NO: 202628 - RNA, 1410 nt, Artificial Sequence
  derived and/or modified sequence opt5 from neuraminidase__InfluenzaA__ADM32804
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuguuggaaauucuagccugugcccuguguccggcugggcgauuuacagcaaggacaacucugucagaaucggguccaaaggagauguguuuguuauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccgucgcuuggucugccagcgcuugccacgacggaaucaauuggcugaccauuggcaucuccgggccugauaacggagccguggcugugcugaaguauaauggcaucauuacagacaccaucaagagcuggagaaacaauauucuccggacacaagagucugagugugccugcgucaacggguccuguuucaccguuaugacggauggaccgagcaauggccaggcgucuuacaaaaucuuucgcauugaaaagggcaaaaucgucaagagcguggagaugaacgcccccaauuaucauuacgaagagugcuccuguuacccugacucuagcgagaucacaugcgugugcagagauaacuggcacggguccaaucggcccugggugagcuucaaccagaaucuggaauaucagauuggauacaucuguucuggcauuuuuggggacaacccucgccccaaugauaaaaccggauccugcggcccgguuagcucuaacggggcuaacggagugaagggcuucuccuuuaaguauggcaauggggucuggaucggaagaacaaaaagcauuuccucucggaacggcuucgagaugaucugggacccuaauggguggaccggaaccgauaacaauuuuagcauuaagcaagacaucguggaaaucaacgagugguccggcuacucugggagcuucguucagcaucccgaacuuacaggccuggacuguauucgcccuugcuucuggguggagcucaucagaggacggcccaaagagaauacgauuuggaccuccggcagcucuaucuccuuuuguggggucaacagcgauacagugggauggucuuggcccgacggcgccgaacugccuuucaccauugauaaguga

SEQ ID NO: 202629 - RNA, 1410 nt, Artificial Sequence
  derived and/or modified sequence opt5 from neuraminidase__InfluenzaA__ADM32814
augaaccccaaucagaagaucauuaccaucggcagcgugugcaugacaauugggauggccaaccugauccuccaaauuggaaauaucaucuccauuuggaucucucacagcauucagcugggcaaccagaaucaggucgagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 202630 - RNA, 1410 nt, Artificial Sequence; identical to SEQ ID NO: 199762
  derived and/or modified sequence opt5 from neuraminidase__InfluenzaA__ADM32824

SEQ ID NO: 202631 - RNA, 1410 nt, Artificial Sequence; identical to SEQ ID NO: 200985
  derived and/or modified sequence opt5 from neuraminidase__InfluenzaA__ADM32834

SEQ ID NO: 202632 - RNA, 1410 nt, Artificial Sequence; identical to SEQ ID NO: 199752
  derived and/or modified sequence opt5 from neuraminidase__InfluenzaA__ADM32844

SEQ ID NO: 202633 - RNA, 1410 nt, Artificial Sequence
  derived and/or modified sequence opt5 from neuraminidase__InfluenzaA__ADM32854
augaaccccaaucagaagaucauuaccaucggcagcgugugcacaacgauugggauggccaaccugauccuccaaauuggaaauaucaucuccauuuggaucucucacagcauucaguucggcaaccagaaucagaucgagaccuguaaccaauccgucauuacauacgaaaauaacaccuggguuaaucagacauaugugaacaucucuaauaccaacuuugcugccgggcagagcguggucuccgugaaacugguuggaaauucuagccuuugcccuguguccggcugggcgauuuacagcaaggacaacucugucagaaucggguccaaaggagauguguucguuauccgggagccguuuauuagcuguucuccccuggaaugccgcacauucuuucucacccagggcgcucugcuuaaugacaagcauuccaacggcacgaucaaagauagaagcccuuaucggacccugaugucuugucccauuggggaggugccuucccccuacaacagccgcuucgaauccgucgccuggucugccagcgcuugccacgacggaaucaauuggcucacaauuggcaucuccgggccugauaacggagccguggcugugcugaaguauaauggcaucauuaccgacacaaucaagagcuggagaaacaauauucugcggacccaagagucugagugugccugcgucaacggguccuguuuuacgguuaugacagauggaccgagcaauggccaggcgucuuacaaaaucuuccgcauugaaaagggcaaaaucgucaagagcguggagaugaacgcccccaauuaucauuacgaagagugcuccuguuacccugacucuagcgagauuaccugcgugugcagagauaacuggcacggguccaaucggcccugggugagcuuuaaccagaaucucgaauaucagaucggauacaucuguucuggcauuuucggggacaacccucgccccaaugauaaaacaggauccugcggcccgguuagcucuaacggggcuaacggagugaagggcuuuuccuucaaguauggcaauggggucuggaucggaagaaccaaaagcauuuccucucggaacggcuuugagaugaucugggacccuaauggguggaccggaacagauaacaauuucagcauuaagcaagacaucgugggcaucaacgaaugguccggguacucuggcagcuucguucagcaucccgagcugacgggacuugacuguauucgcccuugcuuuuggguggaacugaucagaggccggcccaaagagaauaccauuuggacauccgggagcucuaucuccuucuguggagucaacagcgauaccgugggcuggucuuggcccgacggggccgagcucccuuuuacaauugauaaguga

SEQ ID NO: 202634 - RNA, 1410 nt, Artificial Sequence; identical to SEQ ID NO: 199752
  derived and/or modified sequence opt5 from neuraminidase__InfluenzaA__ADM32864

SEQ ID NO: 202635 - RNA, 1410 nt, Artificial Sequence; identical to SEQ ID NO: 199762
  derived and/or modified sequence opt5 from neuraminidase__InfluenzaA__ADM32874

SEQ ID NO: 202636 - RNA, 1410 nt, Artificial Sequence
  derived and/or modified sequence opt5 from neuraminidase__InfluenzaA__ADM32884
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcuguggggcagagcgucguguccguuaaacuugccggaaauucuagccugugcccuguguccggcugggcgauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggcuuggucugccagcgcuugccacgacggaauuaauuggcugaccaucggcaucuccgggccugauaacggagccgucgcugugcugaaguauaauggcauuaucacagacaccauuaagagcuggagaaacaauauccuccggacacaagagucugagugugccugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaaguuuagcaucaaacaagacaucgucggcauuaacgaaugguccggguacucuggcagcuucgugcagcaucccgagcuuacaggacuggauuguauccgcccuugcuucuggguugaacucauuagaggccggcccaaggagaauacgaucuggaccuccgggagcucuauuuccuuuuguggagugaacagcgacacagucggcuggucuuggcccgauggggccgagcugccuuucaccaucgacaaauga

SEQ ID NO: 202637 - RNA, 1410 nt, Artificial Sequence; identical to SEQ ID NO: 199762
  derived and/or modified sequence opt5 from neuraminidase__InfluenzaA__ADM32921

SEQ ID NO: 202638 - RNA, 1410 nt, Artificial Sequence; identical to SEQ ID NO: 199762
  derived and/or modified sequence opt5 from neuraminidase__InfluenzaA__ADM32931

SEQ ID NO: 202639 - RNA, 1410 nt, Artificial Sequence
  derived and/or modified sequence opt5 from neuraminidase__InfluenzaA__ADM32941
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuaauucccggaacggcuucgagaugaucugggauccuaauggguggacaggaaccgacaacaauuuuucuaucaagcaagacauugugggcaucaacgaauggagcggguacuccggcucuuucguccagcaucccgagcuuaccggacuggauuguauucgcccuugcuucuggguggaacucaucagaggccggcccaaagagaauacaauuuggacgagcggguccagcaucucuuuuuguggaguuaacuccgacaccgugggcuggagcuggcccgauggggcugagcugccuuucacaaucgacaaguga

SEQ ID NO: 202640 - RNA, 1410 nt, Artificial Sequence; identical to SEQ ID NO: 199762
  derived and/or modified sequence opt5 from neuraminidase__InfluenzaA__ADM32951

SEQ ID NO: 202641 - RNA, 1410 nt, Artificial Sequence; identical to SEQ ID NO: 200345
  derived and/or modified sequence opt5 from neuraminidase__InfluenzaA__ADM32960

SEQ ID NO: 202642 - RNA, 1410 nt, Artificial Sequence; identical to SEQ ID NO: 199762
  derived and/or modified sequence opt5 from neuraminidase__InfluenzaA__ADM32969

SEQ ID NO: 202643 - RNA, 1410 nt, Artificial Sequence; identical to SEQ ID NO: 199762
  derived and/or modified sequence opt5 from neuraminidase__InfluenzaA__ADM32979

SEQ ID NO: 202644 - RNA, 1410 nt, Artificial Sequence; identical to SEQ ID NO: 201664
  derived and/or modified sequence opt5 from neuraminidase__InfluenzaA__ADM32988

SEQ ID NO: 202645 - RNA, 1410 nt, Artificial Sequence; identical to SEQ ID NO: 201664
  derived and/or modified sequence opt5 from neuraminidase__InfluenzaA__ADM32997

SEQ ID NO: 202646 - RNA, 1410 nt, Artificial Sequence; identical to SEQ ID NO: 199762
  derived and/or modified sequence opt5 from neuraminidase__InfluenzaA__ADM33006

SEQ ID NO: 202647 - RNA, 1410 nt, Artificial Sequence; identical to SEQ ID NO: 201664
  derived and/or modified sequence opt5 from neuraminidase__InfluenzaA__ADM33015

SEQ ID NO: 202648 - RNA, 1410 nt, Artificial Sequence
  derived and/or modified sequence opt5 from neuraminidase__InfluenzaA__ADM33025
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaucuaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 202649 - RNA, 1410 nt, Artificial Sequence; identical to SEQ ID NO: 199762
  derived and/or modified sequence opt5 from neuraminidase__InfluenzaA__ADM33042

SEQ ID NO: 202650 - RNA, 1410 nt, Artificial Sequence; identical to SEQ ID NO: 199762
  derived and/or modified sequence opt5 from neuraminidase__InfluenzaA__ADM33062

SEQ ID NO: 202651 - RNA, 1410 nt, Artificial Sequence
  derived and/or modified sequence opt5 from neuraminidase__InfluenzaA__ADM33071
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcaaaauuacaugcgugugcagagacaauuggcacggguccaaccggcccugggugagcuucaaucagaaccuggaguaucagaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgaaaugauuugggauccuaacggguggaccggaaccgacaauaacuuuagcaucaaacaagacaucgugggcauuaaugagugguccggguacucuggcagcuucguccagcaucccgaacuuacaggacuggauuguauccgcccuugcuucuggguggagcucauuagaggccggcccaaggaaaacacgaucuggaccuccgggagcucuauuuccuuuuguggaguuaauggcgacacagugggguggagcuggcccgauggagcugagcugccuuucaccaucgacaaauga

SEQ ID NO: 202652 - RNA, 1410 nt, Artificial Sequence; identical to SEQ ID NO: 199762
  derived and/or modified sequence opt5 from neuraminidase__InfluenzaA__ADM33081

SEQ ID NO: 202653 - RNA, 1410 nt, Artificial Sequence; identical to SEQ ID NO: 200835
  derived and/or modified sequence opt5 from neuraminidase__InfluenzaA__ADM33091

SEQ ID NO: 202654 - RNA, 1410 nt, Artificial Sequence; identical to SEQ ID NO: 200835
  derived and/or modified sequence opt5 from neuraminidase__InfluenzaA__ADM33101

SEQ ID NO: 202655 - RNA, 1410 nt, Artificial Sequence; identical to SEQ ID NO: 200835
  derived and/or modified sequence opt5 from neuraminidase__InfluenzaA__ADM33111

SEQ ID NO: 202656 - RNA, 1410 nt, Artificial Sequence; identical to SEQ ID NO: 199762
  derived and/or modified sequence opt5 from neuraminidase__InfluenzaA__ADM33121

SEQ ID NO: 202657 - RNA, 1410 nt, Artificial Sequence; identical to SEQ ID NO: 199762
  derived and/or modified sequence opt5 from neuraminidase__InfluenzaA__ADM33130

SEQ ID NO: 202658 - RNA, 1410 nt, Artificial Sequence; identical to SEQ ID NO: 199762
  derived and/or modified sequence opt5 from neuraminidase__InfluenzaA__ADM33139

SEQ ID NO: 202659 - RNA, 1410 nt, Artificial Sequence; identical to SEQ ID NO: 199762
  derived and/or modified sequence opt5 from neuraminidase__InfluenzaA__ADM33149

SEQ ID NO: 202660 - RNA, 1410 nt, Artificial Sequence; identical to SEQ ID NO: 199762
  derived and/or modified sequence opt5 from neuraminidase__InfluenzaA__ADM33159

SEQ ID NO: 202661 - RNA, 1410 nt, Artificial Sequence; identical to SEQ ID NO: 199762
  derived and/or modified sequence opt5 from neuraminidase__InfluenzaA__ADM33169

SEQ ID NO: 202662 - RNA, 1410 nt, Artificial Sequence; identical to SEQ ID NO: 199762
  derived and/or modified sequence opt5 from neuraminidase__InfluenzaA__ADM33179

SEQ ID NO: 202663 - RNA, 1410 nt, Artificial Sequence; identical to SEQ ID NO: 199762
  derived and/or modified sequence opt5 from neuraminidase__InfluenzaA__ADM33188

SEQ ID NO: 202664 - RNA, 1410 nt, Artificial Sequence; identical to SEQ ID NO: 199762
  derived and/or modified sequence opt5 from neuraminidase__InfluenzaA__ADM33197

SEQ ID NO: 202665 - RNA, 1410 nt, Artificial Sequence; identical to SEQ ID NO: 199762
  derived and/or modified sequence opt5 from neuraminidase__InfluenzaA__ADM33206

SEQ ID NO: 202666 - RNA, 1410 nt, Artificial Sequence; identical to SEQ ID NO: 199762
  derived and/or modified sequence opt5 from neuraminidase__InfluenzaA__ADM33215

SEQ ID NO: 202667 - RNA, 1410 nt, Artificial Sequence; identical to SEQ ID NO: 199762
  derived and/or modified sequence opt5 from neuraminidase__InfluenzaA__ADM33224

SEQ ID NO: 202668 - RNA, 1410 nt, Artificial Sequence; identical to SEQ ID NO: 199762
  derived and/or modified sequence opt5 from neuraminidase__InfluenzaA__ADM33234

SEQ ID NO: 202669 - RNA, 1410 nt, Artificial Sequence; identical to SEQ ID NO: 200186
  derived and/or modified sequence opt5 from neuraminidase__InfluenzaA__ADM33243

SEQ ID NO: 202670 - RNA, 1410 nt, Artificial Sequence; identical to SEQ ID NO: 199762
  derived and/or modified sequence opt5 from neuraminidase__InfluenzaA__ADM33253

SEQ ID NO: 202671 - RNA, 1410 nt, Artificial Sequence; identical to SEQ ID NO: 200186
  derived and/or modified sequence opt5 from neuraminidase__InfluenzaA__ADM33262

SEQ ID NO: 202672 - RNA, 1410 nt, Artificial Sequence; identical to SEQ ID NO: 199792
  derived and/or modified sequence opt5 from neuraminidase__InfluenzaA__ADM33272

SEQ ID NO: 202673 - RNA, 1410 nt, Artificial Sequence; identical to SEQ ID NO: 199792
  derived and/or modified sequence opt5 from neuraminidase__InfluenzaA__ADM33282

SEQ ID NO: 202674 - RNA, 1410 nt, Artificial Sequence; identical to SEQ ID NO: 199762
  derived and/or modified sequence opt5 from neuraminidase__InfluenzaA__ADM33292

SEQ ID NO: 202675 - RNA, 1410 nt, Artificial Sequence; identical to SEQ ID NO: 199762
  derived and/or modified sequence opt5 from neuraminidase__InfluenzaA__ADM33302

SEQ ID NO: 202676 - RNA, 1410 nt, Artificial Sequence; identical to SEQ ID NO: 199752
  derived and/or modified sequence opt5 from neuraminidase__InfluenzaA__ADM33312

SEQ ID NO: 202677 - RNA, 1410 nt, Artificial Sequence; identical to SEQ ID NO: 199792
  derived and/or modified sequence opt5 from neuraminidase__InfluenzaA__ADM33322

SEQ ID NO: 202678 - RNA, 1410 nt, Artificial Sequence; identical to SEQ ID NO: 199792
  derived and/or modified sequence opt5 from neuraminidase__InfluenzaA__ADM33332

SEQ ID NO: 202679 - RNA, 1410 nt, Artificial Sequence; identical to SEQ ID NO: 199792
  derived and/or modified sequence opt5 from neuraminidase__InfluenzaA__ADM33342

SEQ ID NO: 202680 - RNA, 1410 nt, Artificial Sequence
  derived and/or modified sequence opt5 from neuraminidase__InfluenzaA__ADM33367
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucguuaccuacgaaaauaacacaugggugaaucagaccuaugugaacauuucuaauacaaacuucgcugccgggcagagcgucguguccguuaaacuugcgggaaauucuagccugugcccugugggcgggugggcuaucuacuccaaggacaacagcgucagaauuggaucuaaaggcgauguguuuguuauccgggagccguucaucuccuguagcccccucgaaugccgcaccuuuuuccugacacagggcgcccuucugaaugacaagcauucuaacgggaccauuaaagauagauccccuuaucggacgcucaugagcugucccaucggagaggugccuucucccuacaacucccgcuuugaaagcgucgccugguccgcuucugccugccacgacggcauuaauuggcugaccaucgggauuagcggaccugauaacggcgcuguggccgugcugaaguauaaugggaucaucacagacaccauuaaguccuggagaaacaauauccuccggacacaagagagcgagugugcgugcgucaacggaucuuguuucaccguuaugacggauggcccguccaauggccaggccagcuacaaaauuuuucgcaucgaaaaggggaaaauugugaagucuguggagaugaacgcucccaauuaucauuacgaagagugcagcuguuacccugacuccucugagaucacaugcgucugcagagauaacuggcacggaagcaaucggcccuggguguccuucaaccagaaucuggaauaucagaucggcuacauuuguagcgggaucuuuggagacaacccucgccccaaugauaaaaccggcucuugcgggccgguuuccagcaacggagccaacggcgugaagggcuucucuuuuaaguaugggaauggagucuggauuggcagaacaaaauccaucagcucccggaacggguucgagaugauuugggacccuaauggauggaccggcaccgauaacaauuuuucuaucaagcaagacauuguggggaucaacgaauggagcggcuacuccggaucuuucguucagcaucccgagcuuacaggccuggacuguauccgcccuugcuucuggguggaacucauuagagggcggcccaaagagaauacgaucuggaccagcggauccagcauuucuuuuuguggcgucaacuccgauacagugggguggagcuggcccgacggagcugagcugccuuucaccaucgauaaguga

SEQ ID NO: 202681 - RNA, 1410 nt, Artificial Sequence; identical to SEQ ID NO: 199792
  derived and/or modified sequence opt5 from neuraminidase__InfluenzaA__ADM33377

SEQ ID NO: 202682 - RNA, 1410 nt, Artificial Sequence; identical to SEQ ID NO: 199792
  derived and/or modified sequence opt5 from neuraminidase__InfluenzaA__ADM33387

SEQ ID NO: 202683 - RNA, 1410 nt, Artificial Sequence; identical to SEQ ID NO: 199762
  derived and/or modified sequence opt5 from neuraminidase__InfluenzaA__ADM33397

SEQ ID NO: 202684 - RNA, 1410 nt, Artificial Sequence; identical to SEQ ID NO: 199762
  derived and/or modified sequence opt5 from neuraminidase__InfluenzaA__ADM33407

SEQ ID NO: 202685 - RNA, 1410 nt, Artificial Sequence; identical to SEQ ID NO: 199792
  derived and/or modified sequence opt5 from neuraminidase__InfluenzaA__ADM33417

SEQ ID NO: 202686 - RNA, 1410 nt, Artificial Sequence; identical to SEQ ID NO: 199762
  derived and/or modified sequence opt5 from neuraminidase__InfluenzaA__ADM33427

SEQ ID NO: 202687 - RNA, 1410 nt, Artificial Sequence
  derived and/or modified sequence opt5 from neuraminidase__InfluenzaA__ADM33437
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuuccgccuacaacagccgcuuugaauccguugcuuggucugccagcgcuugccacgacggaauuaauuggcugaccaucggcaucuccgggcccgauaacggagccguggcgguccugaaguauaauggcauuaucacagacaccauuaagagcuggagaaacaauauccuccggacacaagagucugagugugccugcgugaacggguccuguuucaccgugaugacggauggaccuagcgacggccaggcuucuuacaaaauuuuucgcaucgaaaagggcaaaaucgucaagagcguugagaugaaugccccgaacuaucauuacgaagagugcuccuguuaccccgauucuagcgagauuacaugcgugugcagagacaauuggcacggguccaaccggccuugggugagcuucaaucagaaccuggaauaucagaucggauacauuuguucuggcaucuuuggggauaauccccgcccuaacgacaaaaccggauccugcggccccgucagcucuaauggggcuaacggagugaagggcuucuccuuuaaguauggcaacgggguuuggauuggaagaacaaaaagcaucuccucucggaauggcuucgagaugauuugggauccgaacggguggaccggaaccgacaauaacuuuagcaucaagcaagacaucgugggcauuaaugaaugguccggguacucuggcagcuucguccagcauccugagcuuacaggacuggauuguauccgccccugcuucuggguggaacucauuagaggccggccuaaagagaacacgaucuggaccuccgggagcucuauuuccuuuuguggaguuaauagcgacacagugggcuggucuuggcccgauggggccgagcugcccuucaccaucgacaaguga

SEQ ID NO: 202688 - RNA, 1410 nt, Artificial Sequence; identical to SEQ ID NO: 200116
  derived and/or modified sequence opt5 from neuraminidase__InfluenzaA__ADM33443

SEQ ID NO: 202689 - RNA, 1410 nt, Artificial Sequence; identical to SEQ ID NO: 199762
  derived and/or modified sequence opt5 from neuraminidase__InfluenzaA__ADM52446

SEQ ID NO: 202690 - RNA, 1410 nt, Artificial Sequence; identical to SEQ ID NO: 199762
  derived and/or modified sequence opt5 from neuraminidase__InfluenzaA__ADM52456

SEQ ID NO: 202691 - RNA, 1410 nt, Artificial Sequence; identical to SEQ ID NO: 201967
  derived and/or modified sequence opt5 from neuraminidase__InfluenzaA__ADM52466

SEQ ID NO: 202692 - RNA, 1410 nt, Artificial Sequence; identical to SEQ ID NO: 199762
  derived and/or modified sequence opt5 from neuraminidase__InfluenzaA__ADM52486

SEQ ID NO: 202693 - RNA, 1410 nt, Artificial Sequence; identical to SEQ ID NO: 199752
  derived and/or modified sequence opt5 from neuraminidase__InfluenzaA__ADM52496

SEQ ID NO: 202694 - RNA, 1410 nt, Artificial Sequence; identical to SEQ ID NO: 199762
  derived and/or modified sequence opt5 from neuraminidase__InfluenzaA__ADM52506

SEQ ID NO: 202695 - RNA, 1410 nt, Artificial Sequence; identical to SEQ ID NO: 199752
  derived and/or modified sequence opt5 from neuraminidase__InfluenzaA__ADM52516

SEQ ID NO: 202696 - RNA, 1410 nt, Artificial Sequence; identical to SEQ ID NO: 199752
  derived and/or modified sequence opt5 from neuraminidase__InfluenzaA__ADM52527

SEQ ID NO: 202697 - RNA, 1410 nt, Artificial Sequence; identical to SEQ ID NO: 200985
  derived and/or modified sequence opt5 from neuraminidase__InfluenzaA__ADM52537

SEQ ID NO: 202698 - RNA, 1410 nt, Artificial Sequence; identical to SEQ ID NO: 201486
  derived and/or modified sequence opt5 from neuraminidase__InfluenzaA__ADM52547

SEQ ID NO: 202699 - RNA, 1410 nt, Artificial Sequence; identical to SEQ ID NO: 199752
  derived and/or modified sequence opt5 from neuraminidase__InfluenzaA__ADM52557

SEQ ID NO: 202700 - RNA, 1410 nt, Artificial Sequence; identical to SEQ ID NO: 199752
  derived and/or modified sequence opt5 from neuraminidase__InfluenzaA__ADM52567

SEQ ID NO: 202701 - RNA, 1410 nt, Artificial Sequence; identical to SEQ ID NO: 199752
  derived and/or modified sequence opt5 from neuraminidase__InfluenzaA__ADM52577

SEQ ID NO: 202702 - RNA, 1410 nt, Artificial Sequence; identical to SEQ ID NO: 199762
  derived and/or modified sequence opt5 from neuraminidase__InfluenzaA__ADM52587

SEQ ID NO: 202703 - RNA, 1410 nt, Artificial Sequence; identical to SEQ ID NO: 199762
  derived and/or modified sequence opt5 from neuraminidase__InfluenzaA__ADM52597

SEQ ID NO: 202704 - RNA, 1410 nt, Artificial Sequence; identical to SEQ ID NO: 199752
  derived and/or modified sequence opt5 from neuraminidase__InfluenzaA__ADM52607

SEQ ID NO: 202705 - RNA, 1410 nt, Artificial Sequence; identical to SEQ ID NO: 199752
  derived and/or modified sequence opt5 from neuraminidase__InfluenzaA__ADM52617

SEQ ID NO: 202706 - RNA, 1410 nt, Artificial Sequence; identical to SEQ ID NO: 201443
  derived and/or modified sequence opt5 from neuraminidase__InfluenzaA__ADM52627

SEQ ID NO: 202707 - RNA, 1410 nt, Artificial Sequence; identical to SEQ ID NO: 200985
  derived and/or modified sequence opt5 from neuraminidase__InfluenzaA__ADM52637

SEQ ID NO: 202708 - RNA, 1410 nt, Artificial Sequence; identical to SEQ ID NO: 200985
  derived and/or modified sequence opt5 from neuraminidase__InfluenzaA__ADM52647

SEQ ID NO: 202709 - RNA, 1410 nt, Artificial Sequence; identical to SEQ ID NO: 199752
  derived and/or modified sequence opt5 from neuraminidase__InfluenzaA__ADM52657

SEQ ID NO: 202710 - RNA, 1410 nt, Artificial Sequence; identical to SEQ ID NO: 200985
  derived and/or modified sequence opt5 from neuraminidase__InfluenzaA__ADM52667

SEQ ID NO: 202711 - RNA, 1410 nt, Artificial Sequence; identical to SEQ ID NO: 199752
  derived and/or modified sequence opt5 from neuraminidase__InfluenzaA__ADM52687

SEQ ID NO: 202712 - RNA, 1410 nt, Artificial Sequence; identical to SEQ ID NO: 199752
  derived and/or modified sequence opt5 from neuraminidase__InfluenzaA__ADM52697

SEQ ID NO: 202713 - RNA, 1410 nt, Artificial Sequence; identical to SEQ ID NO: 201443
  derived and/or modified sequence opt5 from neuraminidase__InfluenzaA__ADM52707

SEQ ID NO: 202714 - RNA, 1410 nt, Artificial Sequence
  derived and/or modified sequence opt5 from neuraminidase__InfluenzaA__ADM52717
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcgcgguguccgucaaacuugugggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuuuaaguauggcaaugggguguggaucggaagaacaaaaagcauuuccucucggaacggcuucgagaugaucugggacccuaauggguggaccggaaccgauaacaauuuuagcauuaagcaagacaucgucggcaucaacgaaugguccggguacucuggcagcuucgugcagcaucccgagcuuacaggacuggacuguauucgcccuugcuucuggguugaacucaucagaggccggcccaaagagaauacgauuuggaccuccgggagcucuaucuccuuuuguggagugaacagcgauacagucggcuggucuuggcccgacggggcugagcugccuuucaccauugauaaguga

SEQ ID NO: 202715 - RNA, 1410 nt, Artificial Sequence
  derived and/or modified sequence opt5 from neuraminidase__InfluenzaA__ADM86402
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggcguccgucaaacuugcuggaaauucuagccugugcccuguguccggcugggccauuuacagcaaggacaacucuguuagaaucggguccaaaggagauguguuugucauccgggagccguucauuagcuguucuccccucgaaugccgcaccuuuuuccugacacagggcgcccuucugaaugacaagcauuccaacggcaccgugaaagauagaagcccuuaucggacgcucaugucuugucccaucggggagguuccuucccccuacaacagccgcuuugaauccguggcuuggucugccagcgcuugccacgacggaauuaauuggcugaccaucggcauuuccgggccugauaacggagccgucgcggugcugaaguauaauggcaucaucacagacaccauuaagagcuggagaaacaauauccuccggacacaagagucugagugugccugcgugaacggguccuguuucaccgucaugacggauggaccgagcgacggccaggcuucuuacaaaauuuuucgcaucgaaaagggcaaaauuguuaagagcguggagaugaaugcccccaacuaucauuacgaagagugcuccuguuacccugauucuagcgagaucacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacauugucggcaucaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggccgagcugccuuucaccaucgacaaguga

SEQ ID NO: 202716 - RNA, 1410 nt, Artificial Sequence; identical to SEQ ID NO: 199762
  derived and/or modified sequence opt5 from neuraminidase__InfluenzaA__ADM86412

SEQ ID NO: 202717 - RNA, 1410 nt, Artificial Sequence
  derived and/or modified sequence opt5 from neuraminidase__InfluenzaA__ADM86422
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucguggcugggcagagcgucguguccguuaaacuugccggaaauucuagccugugcccuguguccggcugggcgauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggcuuggucugccagcgcuugccacgacggaauuaauuggcugaccaucggcaucuccgggccugauaacggagccgucgcugugcugaaguauaauggcauuaucacagacaccauuaagagcuggagaaacaauauccuccggacacaagagucugagugugccugcgugaacggguccuguuucaccgucaugacggauggaccgagcgacggccaggcgucuuacaaaauuuuucgcaucgaaaagggcaaaguugucaagagcguggagaugaaugcccccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccgguuagcucuaauggggcuaacggagugaagggcuucuccuuuaaguauggcaacggggucuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguucagcaucccgagcuuacaggacuggauuguauucgcccuugcuucuggguggaacucaucagaggccggcccaaagagaacacgauuuggaccuccgggagcucuaucuccuuuuguggagucaauagcgacacagugggcuggucuuggcccgauggggccgagcugccuuucaccauugacaaguga

SEQ ID NO: 202718 - RNA, 1410 nt, Artificial Sequence; identical to SEQ ID NO: 200616
  derived and/or modified sequence opt5 from neuraminidase__InfluenzaA__ADM86432

SEQ ID NO: 202719 - RNA, 1410 nt, Artificial Sequence
  derived and/or modified sequence opt5 from neuraminidase__InfluenzaA__ADM86443
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugugugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucgucggcaugaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggccgagcugccuuucaccauugacaaguga

SEQ ID NO: 202720 - RNA, 1410 nt, Artificial Sequence; identical to SEQ ID NO: 200345
  derived and/or modified sequence opt5 from neuraminidase__InfluenzaA__ADM86453

SEQ ID NO: 202721 - RNA, 1350 nt, Artificial Sequence
  derived and/or modified sequence opt5 from neuraminidase__InfluenzaA__ADM95377
augaaccccaaucagaagaucauuaccaucggcagcauuugcauggugacagggaucgucucccugaugcuccaaguuggaucuaugauuagcaucugggugucccacucuauccauacgggcaaccagcaccaggccgagccuauuagcaauaccaacuuccugacagaaaaagcuguggccuccgucaaacuugcgggaaauucuagccuguguccgaucaacgggugggcuguguacuccaaggacaauagcauuagaaucggcucuaagggggauguuuuugugauucgggagcccuucaucuccugcagccaucucgaaugucgcaccuuuuuccugacacagggagcccuucugaacgacaaacacucuaauggcaccgucaaggauagauccccucaucggacacucaugagcugccccaugggcgaggccccuucucccuauaacucccgcuuugaaagcguggcuugguccgccucugcuugucacgacgggaccagcuggcugacgauuggaaucuccggcccugauaauggggccguugcggugcugaaguacaacggaaucauuaccgacacaaucaaaagcuggagaaauaacauucuccggacccaagagucugagugcgccugugucaauggcuccugcuucacagugaugaccgaugggccgagcaacggacaggcuucucacaagaucuuuaaaauggaaaagggcaaagugauuaagagcgucgagcuggacgcccccaacuaucauuacgaagaguguuccugcuauccugaugcuggcgagaucacguguguuugccgcgacaauuggcacgggucuaacagacccugggugagcuucaaucagaaccuugaauaccagaucggauauauuugcuccggcguguuuggggauaauccucggcccaacgacggaacaggcagcugugggccggucucuuccaauggagccuacggcgugaagggcuucagcuuuaaauacgggaacggaguuuggaucggccgcaccaagucuacaaauuccagaagcggguucgagaugauuugggauccuaacggauggaccgaaaccgacucccgguuuucugugaaacaagacaucgucgcgauuacagauuggagcggcuauuccgggucuuucgugcagcaucccgagcugacgggccucgacugcauccgcccuuguuucuggguugaacugaucagaggacggcccaaggagagcaccauuuggacauccggcagcucuaucuccuuuugcggggugaauagcgauaccgucggauggucuuggcccgacggcgccgagcuuccuuucacaauugauaaauga

SEQ ID NO: 202722 - RNA, 1410 nt, Artificial Sequence; identical to SEQ ID NO: 199762
  derived and/or modified sequence opt5 from neuraminidase__InfluenzaA__ADM95650

SEQ ID NO: 202723 - RNA, 1410 nt, Artificial Sequence; identical to SEQ ID NO: 199762
  derived and/or modified sequence opt5 from neuraminidase__InfluenzaA__ADM95651

SEQ ID NO: 202724 - RNA, 1410 nt, Artificial Sequence
  derived and/or modified sequence opt5 from neuraminidase__InfluenzaA__ADM95652
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaauuugcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggaaauugcggcccggucuccagcaacggggccaacggagugaagggcuuuucuuucaaguauggcaaugggguuuggauuggaagaacaaaauccaucagcucccggaacggcuuugagaugauuugggauccuaauggguggaccggaaccgacaacaauuucucuaucaagcaagacaucgugggcauuaacgaauggagcggguacuccggcucuuucguccagcaucccgagcugacaggacuugauuguauccgcccuugcuuuuggguggaacugauuagaggccggcccaaagagaauacgaucuggaccagcggguccagcauuucuuucuguggaguuaacuccgacacagugggcuggagcuggcccgauggggcugagcucccuuuuaccaucgacaaguga

SEQ ID NO: 202725 - RNA, 1410 nt, Artificial Sequence
  derived and/or modified sequence opt5 from neuraminidase__InfluenzaA__ADM95654
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggcauggcuucgagaugauuugggauccuaauggguggaccggaaccgacaacaauuuuagcaucaagcaagacaucgugggcacaaacgaaugguccggguacucuggcagcuucguccagcaccccgagcuuacgggacuggauuguauucgcccuugcuucuggguggaacucaucagaggccggcccaaagagaauaccauuuggacauccgggagcucuaucuccuuuuguggaguuaacagcgacaccgugggcuggucuuggcccgauggggcugagcugccuuucacaauugacaaguga

SEQ ID NO: 202726 - RNA, 1410 nt, Artificial Sequence
  derived and/or modified sequence opt5 from neuraminidase__InfluenzaA__ADM95655
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccuccgacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacgacuuuuccaucaagcaagauaucgugggcauuaaugaauggucuggguacagcggcuccuucguccagcaucccgagcuuacaggacuggacuguauccgcccuugcuucuggguggaacucauuagaggccggcccaaagagaacacgaucuggaccagcgggucuuccauuagcuuuuguggaguuaauucugauacagugggcugguccuggcccgacggggcugagcugccuuucaccaucgauaaguga

SEQ ID NO: 202727 - RNA, 1410 nt, Artificial Sequence; identical to SEQ ID NO: 201374
  derived and/or modified sequence opt5 from neuraminidase__InfluenzaA__ADM95656

SEQ ID NO: 202728 - RNA, 1410 nt, Artificial Sequence; identical to SEQ ID NO: 200939
  derived and/or modified sequence opt5 from neuraminidase__InfluenzaA__ADM95658

SEQ ID NO: 202729 - RNA, 1410 nt, Artificial Sequence
  derived and/or modified sequence opt5 from neuraminidase__InfluenzaA__ADM95659
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggagcggcuucgagaugauuugggauccuaauggguggaccggaaccgacaacaauuuuuccaucaagcaagacaucauuggcacaaacgaauggucuggguacagcggcuccuucgugcagcaucccgagcuuacgggacuggauuguauccgcccuugcuucugggucgaacucauuagaggccggcccaaagagaauaccaucuggacaagcgggucuuccauuagcuuuuguggagugaacucugacaccguuggcugguccuggcccgauggggcugagcugccuuucacaaucgacaaguga

SEQ ID NO: 202730 - RNA, 1410 nt, Artificial Sequence; identical to SEQ ID NO: 199762
  derived and/or modified sequence opt5 from neuraminidase__InfluenzaA__ADM95660

SEQ ID NO: 202731 - RNA, 1410 nt, Artificial Sequence
  derived and/or modified sequence opt5 from neuraminidase__InfluenzaA__ADM95661
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcacaaaugaaugguccggguacucuggcagcuucguccagcaucccgagcuuacgggacuggauuguauucgcccuugcuucuggguggaacucaucagaggccggcccaaagagaacaccauuuggacauccgggagcaucauuucuuuuuguggaguuaauuccgacaccgugggcuggagcuggcccgauggggcugagcugccuuucacaaucgacaaguga

SEQ ID NO: 202732 - RNA, 1410 nt, Artificial Sequence; identical to SEQ ID NO: 201374
  derived and/or modified sequence opt5 from neuraminidase__InfluenzaA__ADM95662

SEQ ID NO: 202733 - RNA, 1410 nt, Artificial Sequence
  derived and/or modified sequence opt5 from neuraminidase__InfluenzaA__ADM95663
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuauugagaugaacgcucccaauuaucauuacgaagagugcagcuguuacccugauuccucugagaucacaugcguuugcagagacaacuggcacgggagcaaucggcccuggguguccuucaaccagaaucuggaauaucagauuggauacaucuguagcggcauuuuuggggauaacccucgccccaaugacaaaaccggaucuugcggcccgguguccagcaacggggccaacggagucaagggcuucucuuuuaaguauggcaaugggguguggaucggaagaacaaaauccauuagcucccggaacggcuucgagaugaucugggauccuaauggguggaccggaaccgacaacaauuuuucuaucaagcaagacauuguuggcacaaacgaauggagcggguacuccggcucuuucgugcagcaucccgagcuuacgggacuggauuguauccgcccuugcuucugggucgaacucauuagaggccggcccaaagagaauaccaucuggacaagcggguccauuaucagcuuuuguggagugaacucugacaccguuggcugguccuggcccgauggggcugagcugccuuucacaaucgacaaguga

SEQ ID NO: 202734 - RNA, 1410 nt, Artificial Sequence; identical to SEQ ID NO: 201374
  derived and/or modified sequence opt5 from neuraminidase__InfluenzaA__ADM95664

SEQ ID NO: 202735 - RNA, 1410 nt, Artificial Sequence; identical to SEQ ID NO: 201374
  derived and/or modified sequence opt5 from neuraminidase__InfluenzaA__ADM95665

SEQ ID NO: 202736 - RNA, 1410 nt, Artificial Sequence
  derived and/or modified sequence opt5 from neuraminidase__InfluenzaA__ADM95666
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuuaagaucgaaaaaggcaagaucgucaaaucuguugagaugaacgcucccaauuaucauuacgaagagugcagcuguuacccugauuccucugagauuacaugcgugugccgcgacaacuggcacgggagcaauagacccuggguguccuucaaccagaaucuggaauaucagaucggauacauuuguagcggcaucuuuggggauaacccucggcccaaugacaagaccggaucuugcggcccggucuccuucaacggggccaacggagugaagggcuuuagcuucaaauauggcaaugggguuuggauuggacgcacaaagucuaucuccagcagaaacggcuuugagaugauuugggauccuaauggguggaccggaaccgacaacaauuucuccaucaaacaagacaucgugggcacaaacgaauggucuggguacagcggcuccuucguccagcaucccgagcuuacgggacuggauuguauucggccuugcuuuuggguggaacucauccgcggcagacccaaggagaauaccauuuggacaucugggagcaucauuuccuucuguggaguuaacagcgacaccgugggcuggucuuggcccgauggggcugagcugccuuuuacaaucgacaaauga

SEQ ID NO: 202737 - RNA, 1410 nt, Artificial Sequence; identical to SEQ ID NO: 201374
  derived and/or modified sequence opt5 from neuraminidase__InfluenzaA__ADM95667

SEQ ID NO: 202738 - RNA, 1410 nt, Artificial Sequence; identical to SEQ ID NO: 201374
  derived and/or modified sequence opt5 from neuraminidase__InfluenzaA__ADM95668

SEQ ID NO: 202739 - RNA, 1410 nt, Artificial Sequence; identical to SEQ ID NO: 199762
  derived and/or modified sequence opt5 from neuraminidase__InfluenzaA__ADM95669

SEQ ID NO: 202740 - RNA, 1410 nt, Artificial Sequence; identical to SEQ ID NO: 199762
  derived and/or modified sequence opt5 from neuraminidase__InfluenzaA__ADM95670

SEQ ID NO: 202741 - RNA, 1410 nt, Artificial Sequence
  derived and/or modified sequence opt5 from neuraminidase__InfluenzaA__ADM95672
augaaccccaaucagaagaucauuaccaucggcagcgugugcaugacaauugggauggccaaccugauccuccaaauuggaaauaucaucuccauuuggaucucucacacgauucagcugggcaaccagaaucagaucgagaccuguaaccaaagcgucauuacauacgaaaauaacaccuggguuaaucagacauaugugaacaucuccaauaccaacuucgcugccgggcagucuguggucagcgugaaacuugcgggaaauuccucucugugcccuguuagcggcugggcuauuuacuccaaggacaacagcaucagaaucgggucuaaaggagauguguuugucauucgggagccguucaucuccuguagcccccucgaaugccgcacauuuuuccugacccagggcgcccuucugaaugacaagcauucuaacggcacgauuaaagauagauccccuuaucggacccucaugagcugucccaucggggaggugccuucucccuacaacucccgcuuugaaagcguugccugguccgcuucugccugccacgacggaauuaauuggcugacaaucggcaucagcgggccugauaacggagcuguggccguccugaaguauaauggcauuaucaccgacacaauuaaguccuggagaaacaauauccuccggacccaagagagcgagugugcgugcgugaacgggucuuguuucacggugaugacagauggaccguccgacggccaggccagcuacaaaauuuuucgcaucgaaaagggcaaaaucgucaagucuguugagaugaaugcucccaacuaucauuacgaagagugcagcuguuacccugauuccucugagauuaccugcgugugcagagacaauuggcacgggagcaaccggcccuggguguccuucaaucagaaccuggaauaucagaucggauacauuuguagcggcaucuuuggggauaauccucgccccaacgacaaaacaggaucuugcggcccggucuccagcaauggggccaacggagugaagggcuucucuuuuaaguauggcaacgggguuuggauuggaagaaccaaauccaucagcucccggaauggcuucgagaugauuugggauccuaacggguggaccggaacagacaauaacuuuucuaucaagcaagacaucgugggcacgaaugaauggagcggguacuccggcucuuucguccagcaucccgagcuuaccggacuggauuguauucgcccuugcuucuggguggaacucaucagaggccggcccaaagagaacacaauuuggaccagcggguccagcaucucuuuuuguggaguuaauuccgacacagugggcuggagcuggcccgauggggcugagcugccuuucaccauugacaaguga

SEQ ID NO: 202742 - RNA, 1410 nt, Artificial Sequence; identical to SEQ ID NO: 199762
  derived and/or modified sequence opt5 from neuraminidase__InfluenzaA__ADM95673

SEQ ID NO: 202743 - RNA, 1410 nt, Artificial Sequence; identical to SEQ ID NO: 201374
  derived and/or modified sequence opt5 from neuraminidase__InfluenzaA__ADM95674

SEQ ID NO: 202744 - RNA, 1410 nt, Artificial Sequence; identical to SEQ ID NO: 199762
  derived and/or modified sequence opt5 from neuraminidase__InfluenzaA__ADM95675

SEQ ID NO: 202745 - RNA, 1410 nt, Artificial Sequence
  derived and/or modified sequence opt5 from neuraminidase__InfluenzaA__ADM95677
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcacaaacgaauggagcggguacuccggcucuuucguccagcaucccgagcuuacgggacuggauuguauucgcccuugcuucuggguggaacucaucagaggccggcccaaagagaauaccauuuggacaagcggguccaucauuagcuuuuguggaguuaacucugacaccgugggcugguccuggcccgauggggcugagcugccuuucacaaucgacaaguga

SEQ ID NO: 202746 - RNA, 1410 nt, Artificial Sequence
  derived and/or modified sequence opt5 from neuraminidase__InfluenzaA__ADM95678
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaauuugcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuucguccagcaucccgagcugacaggacuugauuguauccgcccuugcuuuuggguggaacugauuagaggccggcccaaagagaacacgaucuggaccuccgggagcucuauuuccuucuguggaguuaauagcgacacagugggcuggucuuggcccgauggggcugagcucccuuuuaccaucgacaaguga

SEQ ID NO: 202747 - RNA, 1410 nt, Artificial Sequence; identical to SEQ ID NO: 202745
  derived and/or modified sequence opt5 from neuraminidase__InfluenzaA__ADM95679

SEQ ID NO: 202748 - RNA, 1410 nt, Artificial Sequence; identical to SEQ ID NO: 202745
  derived and/or modified sequence opt5 from neuraminidase__InfluenzaA__ADM95680

SEQ ID NO: 202749 - RNA, 1410 nt, Artificial Sequence; identical to SEQ ID NO: 199762
  derived and/or modified sequence opt5 from neuraminidase__InfluenzaA__ADM95681

SEQ ID NO: 202750 - RNA, 1410 nt, Artificial Sequence
  derived and/or modified sequence opt5 from neuraminidase__InfluenzaA__ADM95682
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagauuuguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaccaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 202751 - RNA, 1410 nt, Artificial Sequence
  derived and/or modified sequence opt5 from neuraminidase__InfluenzaA__ADM95683
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauguccuuuuguggaguuaauagcgacacagugggcuggucuuggcccgauggggcugagcugccuuucaccauugacaaguga

SEQ ID NO: 202752 - RNA, 1410 nt, Artificial Sequence; identical to SEQ ID NO: 199762
  derived and/or modified sequence opt5 from neuraminidase__InfluenzaA__ADM95684

SEQ ID NO: 202753 - RNA, 1410 nt, Artificial Sequence
  derived and/or modified sequence opt5 from neuraminidase__InfluenzaA__ADM95685
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggcauggcuucgagaugauuugggauccuaauggguggaccggaaccgacaacaauuuuagcaucaagcaagacaucgugggcacaaacgaaugguccggguacucuggcagcuucguccagcaccccgagcuuacgggacuggauuguauucgcccuugcuucuggguggaacucaucagaggccggcccaaagagaauaccguuuggacauccgggagcucuauuuccuuuuguggagugaacagcgacaccgucggcuggucuuggcccgauggggcugagcugccuuucacaaucgacaaguga

SEQ ID NO: 202754 - RNA, 1410 nt, Artificial Sequence
  derived and/or modified sequence opt5 from neuraminidase__InfluenzaA__ADM95686
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaaugacuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 202755 - RNA, 1410 nt, Artificial Sequence; identical to SEQ ID NO: 199762
  derived and/or modified sequence opt5 from neuraminidase__InfluenzaA__ADM95687

SEQ ID NO: 202756 - RNA, 1410 nt, Artificial Sequence
  derived and/or modified sequence opt5 from neuraminidase__InfluenzaA__ADM95688
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcacaaaugaaugguccggguacucuggcagcuucguccagcaucccgagcuuacgcgccuggauuguauuagaccuugcuucuggguggaacucauccggggacgccccaaagagaacaccauuuggacauccggcagcaucauuucuuuuugugggguuaauuccgacaccgugggauggagcuggcccgauggcgcugagcugccuuucacaaucgacaaguga

SEQ ID NO: 202757 - RNA, 1410 nt, Artificial Sequence; identical to SEQ ID NO: 202754
  derived and/or modified sequence opt5 from neuraminidase__InfluenzaA__ADM95689

SEQ ID NO: 202758 - RNA, 1410 nt, Artificial Sequence
  derived and/or modified sequence opt5 from neuraminidase__InfluenzaA__ADM95690
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucauuggcacaaaugaaugguccggguacucuggcagcuucgugcagcaucccgagcuuacgggacuggauuguauccgcccuugcuucugggucgaacucauuagaggccggcccaaagagaacaccaucuggacauccgggagcucuauuuccuuuuguggagugaauagcgacaccguuggcuggucuuggcccgauggggcugagcugccuuucacaaucgacaaguga

SEQ ID NO: 202759 - RNA, 1410 nt, Artificial Sequence; identical to SEQ ID NO: 199762
  derived and/or modified sequence opt5 from neuraminidase__InfluenzaA__ADM95691

SEQ ID NO: 202760 - RNA, 1410 nt, Artificial Sequence
  derived and/or modified sequence opt5 from neuraminidase__InfluenzaA__ADM95692
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucauuaauacaaacuucgcugccgggcagucuguggucagcgugaaacuugcgggaaauuccucucugugcccuguuagcggcugggcuaucuacuccaaggacaacagcaucagaauugggucuaaaggagauguguuugucauccgggagccguucauuuccuguagcccccucgaaugccgcaccuuuuuccugacacagggcgcccuucugaaugacaagcauucuaacggcaccaucaaagauagauccccuuaucggacgcucaugagcugucccauuggggaggugccuucucccuacaacucccgcuuugaaagcguugccugguccgcuucugccugccacgacggaaucaauuggcugaccaucggcauuagcgggccugauaacggagcuguggccguccugaaguauaauggcaucauuacagacaccaucaaguccuggagaaacaauauucuccggacacaagagagcgagugugcgugcgugaacgggucuuguuucaccgugaugacggauggaccguccgacggccaggccagcuacaaaaucuuucgcaucgaaaagggcaaaauugucaagucuguugagaugaaugcucccaacuaucauuacgaagagugcagcuguuacccugauuccucugagaucacaugcgugugcagagacaauuggcacgggagcaaccggcccuggguguccuucaaucagaaccuggaauaucagauuggauacaucuguagcggcauuuuuggggauaauccucgccccaacgacaaaaccggaucuugcggcccggucuccagcaauggggccaacggagugaagggcuucucuuuuaaguauggcaacgggguuuggaucggaagaacaaaauccauuagcucccggaauggcuucgagaugaucugggauccuaacggguggaccggaaccgacaauaacuuuucuaucaagcaagacauugugggcaucaaugaauggagcggguacuccggcucuuucguccagcaucccgagcuuacaggacuggauuguauucgcccuugcuucuggguggaacucaucagaggccggcccaaagagaacacgauuuggaccagcggguccagcaucucuuuuuguggaguuaauuccgacacagugggcuggagcuggcccgauggggcugagcugccuuucaccaucgacaaguga

SEQ ID NO: 202761 - RNA, 1410 nt, Artificial Sequence; identical to SEQ ID NO: 199762
  derived and/or modified sequence opt5 from neuraminidase__InfluenzaA__ADM95693

SEQ ID NO: 202762 - RNA, 1410 nt, Artificial Sequence; identical to SEQ ID NO: 199762
  derived and/or modified sequence opt5 from neuraminidase__InfluenzaA__ADM95694

SEQ ID NO: 202763 - RNA, 1410 nt, Artificial Sequence; identical to SEQ ID NO: 199762
  derived and/or modified sequence opt5 from neuraminidase__InfluenzaA__ADM95695

SEQ ID NO: 202764 - RNA, 1410 nt, Artificial Sequence; identical to SEQ ID NO: 202754
  derived and/or modified sequence opt5 from neuraminidase__InfluenzaA__ADM95696

SEQ ID NO: 202765 - RNA, 1410 nt, Artificial Sequence; identical to SEQ ID NO: 201374
  derived and/or modified sequence opt5 from neuraminidase__InfluenzaA__ADM95697

SEQ ID NO: 202766 - RNA, 1413 nt, Artificial Sequence
  derived and/or modified sequence opt5 from neuraminidase__InfluenzaA__ADM95698
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacaauacaugggugaaccauaccuaugucaauaucaacaauacaaacguuguggccgaagaggacaaaaccuccgugacacuggcgggaaauucuagccuuuguuccauuagcggcugggcuaucuacaccaaggauaacucuauucggaucggguccaaaggagacgucuucgugauucgcgaaccuuuuaucagcugcucucaccuggaguguagaacguucuuucucacccaaggcgcccugcuuaaugauaagcauuccaacggcacaguuaaagaccggagcccguaucgcgcccugaugucuugcccccucggggaagcuccuucccccuacaacagcaaguucgaguccguggccuggucugcuagcgccugucacgauggaaugggcuggcugaccaucgggauuuccggaccugacaauggcgcggucgccgugcugaaguauaacgggaucauuacaggaaccaucaaaagcuggaagaaacagauucucagaacgcaggagucugaaugcguuuguaugaauggcuccugcuuuacaaucaugaccgauggccccagcaacaaggcugccucuuacaaaaucuucaagauugagaaggggaaagugacaaagagcaucgaacugaaugcuccuaacuuucauuaugaggaguguuccugcuacccggacaccggaauugucaugugugugugccgggauaauuggcacggcucuaaccgccccugggugagcuucaaucagaaccuugacuaccaaaucggguauauuugcuccggagucuuuggcgauaauccuagacccgaagacggggagggaagcuguaacccuguuaccguggauggcgccaauggcgugaaaggguucucuuacaaguaugacaacggagucuggaucggccggacaaaauccaaucgccugagaaagggguuugaaaugauuugggaccccaacggauggacgaacaccgauagcgacuucucugugaaacaggauguuguggcgaucacagacugguccggcuacagcggguccuuuguccagcacccggagcucaccggccuggauugcauccggccuuguuucuggguggaacuuguucgcggacagcccagagagaauacaaccauuuggacgucuggcagcuccaucucuuucugcggggugaacagcgacacagccaauugguccuggccugauggagcugagcugcccuuuaccauugacaaguga

SEQ ID NO: 202767 - RNA, 1413 nt, Artificial Sequence
  derived and/or modified sequence opt5 from neuraminidase__InfluenzaA__ADM95699
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacaauacaugggugaaccauaccuaugucaauaucaacaauacaaacguuguggccgaagaggacaaaaccuccgugacacuggcgggaaauucuagccuuuguuccauuagcggcugggcuaucuacaccaaggauaacucuauucggaucggguccaaaggagacgucuucgugauucgcgaaccuuuuaucagcugcucucaccuggaguguagaacguucuuucucacccaaggcgcccugcuuaaugauaagcauuccaacggcacaguuaaagaccggagcccguaucgcgcccugaugucuugcccccucggggaagcuccuucccccuacaacagcaaguucgaguccguggccuggucugcuagcgccugucacgauggaaugggcuggcugaccaucgggauuuccggaccugacaauggcgcggucgccgugcugaaguauaacgggaucauuacaggaaccaucaaaagcuggaagaaacagauucucagaacgcaggagucugaaugcguuuguaugaauggcuccugcuuuacaaucaugaccgauggccccagcaacaaggcugccucuuacaaaaucuucaagauugagaaggggaaagugacaaagagcaucgaacugaaugcuccuaacuuuuauuacgaggaguguuccugcuacccggacaccggaauugucaugugugugugccgggauaauuggcauggcucuaaccgccccugggugagcuucaaucagaaccuugacuaucaaaucggguacauuugcuccggagucuuuggcgauaauccuagacccgaagacggggagggaagcuguaacccuguuaccguggauggcgccaauggcgugaaaggguucucuuauaaguacgacaacggagucuggaucggccggacaaaauccaaucgccugagaaagggguuugaaaugauuugggaccccaacggauggacgaacaccgauagcgacuucucugugaaacaggauguuguggcgaucacagacugguccggcuauagcggguccuuuguccagcacccggagcucaccggccuggauugcauccggccuuguuucuggguggaacuuguucgcggacugcccagagagaauacaaccauuuggacgucuggcagcuccaucucuuucugcggggugaacagcgacacagccaauugguccuggccugauggagcugagcuccccuuuaccauugacaaguga

SEQ ID NO: 202768 - RNA, 1413 nt, Artificial Sequence
  derived and/or modified sequence opt5 from neuraminidase__InfluenzaA__ADM95701
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacaauacaugggugaaccauaccuaugucaauaucaacaauacaaacguuguggccgaagaggacaaaaccuccgugacacuggcgggaaauucuagccuuuguuccauuagcggcugggcuaucuacaccaaggauaacucuauucggaucggguccaaaggagacgucuucgugauucgcgaaccuuuuaucagcugcucucaccuggaguguagaacguucuuucucacccaaggcgcccugcuuaaugauaagcauuccaacggcacaguuaaagaccggagcccguaucgcgcccugaugucuugcccccucggggaagcuccuucccccuacaacagcaaguucgaguccguggccuggucugcuagcgccugucacgauggaaugggcuggcugaccaucgggauuuccggaccugacaauggcgcggucgccgugcugaaguauaacgggaucauuacaggaaccaucaaaagcuggaagaaacagauucucagaacgcaggagucugaaugcguuuguaugaauggcuccugcuuuacaaucaugaccgauggccccagcaacaaggcugccucuuacaaaaucuucaagauugagaaggggaaagugacaaagagcaucgaacugaaugcuccuaacuuucauuaugaggaguguuccugcuacccggacaccggaauugucaugugugugugccgggauaauuggcacggcucuaaccgccccugggugagcuucaaucagaaccuugacuaccaaaucggguauauuugcuccggagucuuuggcgauaauccuagacccgaagacggggagggaagcuguaacccuguuaccguggauggcgccaauggcgugaaaggguucucuuacaaguaugacaacggagucuggaucggccggacaaaauccaaucgccugagaaagggguuugaaaugauuugggaccccaacggauggacgaacaccgauagcgacuucucugugaaacaggauguuguggcgaucacagacugguccggcuacagcggguccuuuguccagcacccggagcucaccggccuggauugcauccggccuuguuucuggguggaacuuguucgcggacugcccagagagaauacaaccauuuggacgucuggcagcuccaucucuuucugcggggugaacagcgacacagccaauugguccuggccugauggagcugagcuccccuuuaccauugacaaguga

SEQ ID NO: 202769 - RNA, 1413 nt, Artificial Sequence
  derived and/or modified sequence opt5 from neuraminidase__InfluenzaA__ADM95702
augaaccccaaucagaagaucauuaccaucggcagcauuuccaucgccauugggaucaucucucugaugcuccaaauuggaaacaucauuagcaucugggcuucccacucuauucagacaggcagacagaauaacacggggaucugcaaucagcggauuaucaccuacgagaacagcacaugggugaaucauaccuaugucaacaucaauaacacaaaaguuguggccggagaagacaagaccuccgugacacuggcgggcaauucuagccuuuguuccauuagcgggugggcuaucuacaccaaagauaacucuauucgcaucggauccaagggcgacgucuucgugauuagagagccuuuuaucagcugcucucaccuggaaugucggacguucuuucucacccaaggcgcccugcuuaaugauaaacauuccaacgggacaguuaaggaccgcagcccguauagagcccugaugucuugcccccucggagaggcuccuucccccuacaauagcaaguucgaauccguggccuggucugcuagcgccugucacgauggcaugggguggcugaccaucggaauuuccggcccugacaacggggcggucgccgugcugaaauauaacggaaucauuacaggcaccaucaagagcuggaaaaagcagauucuccggacgcaggagucugagugcguuuguaugaauggcuccugcuuuacaaucaugaccgaugggcccagcaacaaagcugccucuuacaagaucuucaagauugaaaaaggaaaggugacaaaaagcaucgagcugaaugcuccuaacuuuuauuacgaagaguguuccugcuacccggacaccggcauugucaugugugugugccgcgauaauuggcaugggucuaacagacccugggugagcuucaaucagaaccuugacuaucaaaucggauacauuugcuccggcgucuuuggggauaauccucggcccgaggacggagaaggcagcuguaacccuguuaccguggauggcgccaauggggugaagggauucucuuauaaauacggcaacggggucuggaucggacgcacaaaguccaauagacugcggaaaggcuuugaggugauuugggaccccaacggguggacgaauaccgacagcgauuucucuguuaagcaggacguggucgcgaucacagauugguccggcuauagcggauccuuugugcagcacccggaacucaccggccuggacugcauccgcccuuguuucuggguugagcuugugagagggcugccccgggaaaacacaaccauuuggacgucuggaagcuccaucucuuucugcggcgucaacagcgauacagccaauugguccuggccugacggggcugagcuccccuuuaccauugauaaguga

SEQ ID NO: 202770 - RNA, 1413 nt, Artificial Sequence
  derived and/or modified sequence opt5 from neuraminidase__InfluenzaA__ADM95704
augaaccccaaucagaagaucauuaccaucggcagcauuuccaucgccauugggaucaucucucugaugcuccaaauuggaaacaucgugagcauuugggcuucccacucuauccagacaggcagccagaauaacacggggauuugcaaucagagaaucauuaccuacgagaacaauacaugggucaaccauaccuauguuaauaucaacaauacaaacgugguggccgaagaggacaaaaccuccgucacacuggcgggaaauucuagccuuuguuccaucagcggcugggcuauuuacaccaaggauaacucuauccggauuggguccaaaggagacguguucguuauccgcgaaccuuuuauuagcugcucucaccuggaguguagaacguucuuucucacccaaggcgcccugcuuaaugauaagcauuccaacggcacagugaaagaccggagcccguaucgcgcccugaugucuugcccccucggggaagcuccuucccccuacaacagcaaguucgaguccgucgccuggucugcuagcgccugucacgauggaaugggcuggcugaccaucgggaucuccggaccugacaauggcgcgguggccguucugaaguauaacgggauuaucacaggaaccauuaaaagcuggaagaaacagauccucagaacgcaggagucugaaugcguguguaugaauggcuccugcuuuacaauuaugaccgauggccccagcaaccgggcugccucuuacaagaucuucaaaaucgagaaggggaaggucacaaaaagcauugaacugaaugcuccuaacuuucauuaugaggaguguuccugcuacccggacaccggaaucgugaugugugugugccgcgauaauuggcacggcucuaacagacccugggucagcuucaaucagaaccuugacuaccaaauuggguauaucugcuccggaguuuuuggcgauaauccucggcccgaagacggggagggaagcuguaacccugugaccguggauggcgccaauggcgucaagggguucucuuacaaauaugacaacggaguguggauuggccgcacaaaguccaauagacugcggaaaggguuugaaaugaucugggaccccaacggauggacgaacaccgauagcgacuucucuguuaagcaggauguggucgcgauuacagacugguccggcuacagcggguccuuugugcagcacccggagcucaccggccuggauugcauccgcccuuguuucuggguugaacuugugagaggacugccccgggagaauacaaccaucuggacgucuggcagcuccauuucuuucugcggggucaacagcgacacagccaauugguccuggccugauggagcugagcuccccuuuaccaucgacaaauga

SEQ ID NO: 202771 - RNA, 1413 nt, Artificial Sequence
  derived and/or modified sequence opt5 from neuraminidase__InfluenzaA__ADM95705
augaaccccaaucagaagaucauuaccaucggcagcauuuccaucgccauugggaucaucucucugaugcuccaaauuggaaacaucauuagcaucugggcuucccacucuauucagacaggcagacagaauaacacggggaucugcaaucagcggauuaucaccuacgagaacagcacaugggugaaucauaccuaugucaacaucaauaacacaaaaguuguggccggagaagacaagaccuccgugacacuggcgggcaauucuagccuuuguuccauuagcgggugggcuaucuacaccaaagauaacucuauucgcaucggauccaagggcgacgucuucgugauuagagagccuuuuaucagcugcucucaccuggaaugucggacguucuuucucacccaaggcgcccugcuuaaugauaaacauuccaacgggacaguuaaggaccgcagcccguauagagcccugaugucuugcccccucggagaggcuccuucccccuacaauagcaaguucgaauccguggccuggucugcuagcgccugucacgauggcaugggguggcugaccaucggaauuuccggcccugacaacggggcggucgccgugcugaaauauaacggaaucauuacaggcaccaucaagagcuggaaaaagcagauucuccggacgcaggagucugagugcguuuguaugaauggcuccugcuuuacaaucaugaccgaugggcccagcaacaaagcugccucuuacaagaucuucaagauugaaaaaggaaaggugacaaaaagcaucgagcugaaugcuccuaacuuuuauuacgaagaguguuccugcuacccggacaccggcauugucaugugugugugccgcgauaauuggcaugggucuaacagacccugggugagcuucaaucagaaccuugacuaucaaaucggauacauuugcuccggcgucuuuggggauaauccucggcccgaggacggagaaggcagcuguaacccuguuaccguggauggcgccaauggggugaagggauucucuuauaaauacggcaacggggucuggaucggacgcacaaaguccaauagacugcggaaaggcuuugagaugauuugggaccccaacggguggacgaauaccgacagcgauuucucugugaagcaggacguuguggcgaucacagauugguccggcuauagcggauccuuuguccagcacccggaacucaccggccuggacugcauccgcccuuguuucuggguggagcuuguuagagggcugccccgggaaaacacaaccauuuggacgucuggaagcuccaucucuuucugcggcgugaacagcgauacagccaauugguccuggccugacggggcugagcuccccuuuaccauugauaaguga

SEQ ID NO: 202772 - RNA, 1413 nt, Artificial Sequence; identical to SEQ ID NO: 202771
  derived and/or modified sequence opt5 from neuraminidase__InfluenzaA__ADM95706

SEQ ID NO: 202773 - RNA, 1413 nt, Artificial Sequence; identical to SEQ ID NO: 202771
  derived and/or modified sequence opt5 from neuraminidase__InfluenzaA__ADM95707

SEQ ID NO: 202774 - RNA, 1413 nt, Artificial Sequence; identical to SEQ ID NO: 200485
  derived and/or modified sequence opt5 from neuraminidase__InfluenzaA__ADM95708

SEQ ID NO: 202775 - RNA, 1410 nt, Artificial Sequence
  derived and/or modified sequence opt5 from neuraminidase__InfluenzaA__ADM95710
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacaauauuguuucuuccuacguguguagcggacuugucggcgacacgccccggaagaacgauucuagcuccucuagccauugccuggacccgaauaacgaggaaggcgggcacggagugaaaggcugggccuucgaugacgggaaugauguuuggaugggacgcaccaucuccgagaagucuagacucggcuaugagacauuuaaagugaucgaaggguggucuaacccuaaguccaaacugcagauuaaucggcaggucaucguggaccgcggaaacagaagcggcuacucuggcauuuucuccgucgagggaaagagcuguaucaaucggugcuuuuauguggaacugauuagagggcgcaaggaggaaaccgauguucucuggaccuccaacucuaucguggucuucuguggcacaagcgggaccuacggaacaggcuccuggcccgacggggcugauauuaaucugaugccuaucuga

SEQ ID NO: 202776 - RNA, 1410 nt, Artificial Sequence; identical to SEQ ID NO: 199623
  derived and/or modified sequence opt5 from neuraminidase__InfluenzaA__ADM95711

SEQ ID NO: 202777 - RNA, 1410 nt, Artificial Sequence; identical to SEQ ID NO: 199623
  derived and/or modified sequence opt5 from neuraminidase__InfluenzaA__ADM95712

SEQ ID NO: 202778 - RNA, 1410 nt, Artificial Sequence; identical to SEQ ID NO: 199623
  derived and/or modified sequence opt5 from neuraminidase__InfluenzaA__ADM95713

SEQ ID NO: 202779 - RNA, 1410 nt, Artificial Sequence
  derived and/or modified sequence opt5 from neuraminidase__InfluenzaA__ADM95714
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgauguucucuggaccucuaauagcaucguggucuucuguggcacauccgggaccuacggaacaggcucuuggcccgacggggcugauauuaaccugaugccuaucuga

SEQ ID NO: 202780 - RNA, 1410 nt, Artificial Sequence; identical to SEQ ID NO: 199623
  derived and/or modified sequence opt5 from neuraminidase__InfluenzaA__ADM95715

SEQ ID NO: 202781 - RNA, 1410 nt, Artificial Sequence; identical to SEQ ID NO: 202779
  derived and/or modified sequence opt5 from neuraminidase__InfluenzaA__ADM95716

SEQ ID NO: 202782 - RNA, 1410 nt, Artificial Sequence; identical to SEQ ID NO: 202779
  derived and/or modified sequence opt5 from neuraminidase__InfluenzaA__ADM95717

SEQ ID NO: 202783 - RNA, 1410 nt, Artificial Sequence; identical to SEQ ID NO: 199623
  derived and/or modified sequence opt5 from neuraminidase__InfluenzaA__ADM95718

SEQ ID NO: 202784 - RNA, 1410 nt, Artificial Sequence
  derived and/or modified sequence opt5 from neuraminidase__InfluenzaA__ADM95719
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagauccggcuaugagacauuuaaagugaucgaaggguggagcaauccuaagucuaaacuccagauuaaccggcaggucaucguggaccgcggaaauagauccggcuacagcggcauuuucuccgucgaggggaagucuuguaucaaccggugcuuuuauguggaacugauuagaggacgcaaggaggaaaccgagguucuguggaccagcaauuccaucguggucuucuguggcacaucugggaccuacggaacaggcagcuggcccgauggggcugacauuaaccucaugccuaucuga

SEQ ID NO: 202785 - RNA, 1410 nt, Artificial Sequence; identical to SEQ ID NO: 199623
  derived and/or modified sequence opt5 from neuraminidase__InfluenzaA__ADM95720

SEQ ID NO: 202786 - RNA, 1410 nt, Artificial Sequence; identical to SEQ ID NO: 199623
  derived and/or modified sequence opt5 from neuraminidase__InfluenzaA__ADM95721

SEQ ID NO: 202787 - RNA, 1410 nt, Artificial Sequence; identical to SEQ ID NO: 199623
  derived and/or modified sequence opt5 from neuraminidase__InfluenzaA__ADM95723

SEQ ID NO: 202788 - RNA, 1410 nt, Artificial Sequence
  derived and/or modified sequence opt5 from neuraminidase__InfluenzaA__ADM95724
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaacagcaagcugcagauuaaucggcaggucaucguggaccgcggaaacagaucuggcuacuccggcauuuucagcgucgaggggaaauccuguaucaaucggugcuuuuauguggaacugauuagaggacgcaaggaggaaaccgagguucucuggaccucuaacagcaucguggucuucuguggcacauccgggaccuacggaacaggcucuuggcccgauggggcugacauuaaucugaugccuaucuga

SEQ ID NO: 202789 - RNA, 1410 nt, Artificial Sequence
  derived and/or modified sequence opt5 from neuraminidase__InfluenzaA__ADM95725
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaagugugccccaaacucgcugaguaccggaauuggagcaagccucagugugacaucaccggguucgcccccuuuuccaaagauaacucuauucgccugagcgcgggaggcgacaucugggucacaagagagccuuauguguccugcgauccggacaaguguuaccaauucgcucuugggcagggaaccacacugaauaacguucauucuaauaacaccgugcgggaucgcacgcccuauagaacacuccugaugaaugaacugggcgucccuuuucaccucgggaccaaacaggugugcaucgccuggagcuccagcucuugucaugacggaaaggccuggcugcacguuugcauuacaggcgaugacaagaacgcuaccgccuccuucaucuacaauggccggcuuguggauagcgucgugucuugguccaaagagauucugcgcacccaggaaagcgagugugugugcaucaacgggacauguacggucguuauuaccgacggaucugcuuccggcaaggccgauacaaaaauccucuuuaucgaggaagggaagauugugcauaccagcacacuguccggaucugcgcaacacguggaggaaugcagcugcuaucccagauacccuggcguccggugugugugccgcgacaacuggaagggguccaauagacccaucguugauauuaacaucaaagaccacagcauugugucuuccuacgucuguagcggacuugugggcgacaccccgcggaagaaugauucuagcuccucuagccauugccuggacccuaacaaugaggaaggcgggcacggaguuaaaggcugggccuucgaugacgggaacgauguguggaugggacgcacgaucuccgaaaagagcagacucggcuaugagacauuuaaagucaucgagggguggucuaaucccaaguccaaacugcagauuaaccgccaggugaucgucgaccggggaaauagaagcggcuacucuggcauuuucuccguggagggaaagagcuguaucaaccggugcuuuuauguugaacugauuagagggcgcaaggaggaaaccgaugugcucuggaccuccaauucuaucgucguguucuguggcacaagcgggaccuacggaacaggcuccuggccugacggggcugauauuaaccugaugcccaucuga

SEQ ID NO: 202790 - RNA, 1410 nt, Artificial Sequence
  derived and/or modified sequence opt5 from neuraminidase__InfluenzaA__ADM95726
augaaccccaaucagaagaucauuaccaucggcagcgugucccugacaauuucuacgaucugcuucuuuaugcaaauugccauccucaucaccgcugucacacugcacuucaaacaguacgaguuuaacagcccuccgaauaaccagguuaugcuuugugaacccaccauuaucgagagaaauauuacagaaaucguguaucugaccaacacaaccauugagaaggaaaucugcccuaaacucgccgaguaccggaauugguccaagccccagugugacauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaauaacacaguucgggaucgcaccccguauagaacgcuccugaugaaugaacugggcgugcccuuucaccucgggacaaagcaggucugcauugccugguccucuagcuccugucaugacggaaaggcuuggcugcacgugugcaucaccggcgaugacaaaaacgccacagcuagcuucauuuacaauggccggcuuguugauucuguggucuccuggagcaaagagauccugcgcacccaggaaucugagugugugugcauuaacgggaccuguacaguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucagcgagaagucuagacucggcuaugagacguuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaacagauguucucuggaccucuaauagcaucguggucuucuguggcaccuccgggacauacggaaccggcucuuggcccgacggggccgauauuaaccugaugccuaucuga

SEQ ID NO: 202791 - RNA, 1410 nt, Artificial Sequence; identical to SEQ ID NO: 199623
  derived and/or modified sequence opt5 from neuraminidase__InfluenzaA__ADM95727

SEQ ID NO: 202792 - RNA, 1410 nt, Artificial Sequence
  derived and/or modified sequence opt5 from neuraminidase__InfluenzaA__ADM95728
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccugagcucgcugaguaccggaauugguccaaaccccagugugacauuaccggguucgccccuuuuucuaaggauaacagcauccgccuguccgcgggaggcgacaucugggugacaagagaacccuaugucucuugcgauccugacaaauguuaccaauucgcucuugggcagggaaccacacugaauaacgugcauagcaauaacaccguucgggaucgcacgccguauagaacacuccugaugaaugagcugggcgugcccuuucaccucgggaccaagcaggucugcauugccugguccucuagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugagugugugugcauuaacgggacauguacgguggucaugaccgacggauccgcuagcggcaaagccgauacaaagauccucuuuaucgaagaggggaaaauuguucauaccuccacacugucuggaagcgcgcaacacguggaagagugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucagcgagaaaucuagacucggcuaugaaacauuuaaggugaucgaggggugguccaauccuaaaagcaagcugcagauuaaccggcaggucaucguggaccgcggaaauagaucuggcuacuccggcauuuucagcgucgaagggaaauccuguaucaaccggugcuuuuauguggagcugauuagaggacgcaaggaagagaccgagguucucuggaccucuaauagcaucguggucuucuguggcacauccgggaccuacggaacaggcucuuggcccgauggggcugacauuaaccugaugccuaucuga

SEQ ID NO: 202793 - RNA, 1410 nt, Artificial Sequence
  derived and/or modified sequence opt5 from neuraminidase__InfluenzaA__ADM95729
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucucgcagccauugccuggacccgaacaaugaggaaggcgggcacggagugaaaggcugggccuucgaugacgggaacgauguuuggaugggaagaaccaucuccgagaagucucggcucggcuaugagacauuuaaagugaucgaaggguggucuaauccuaaguccaaacugcagauuaaccgccaggucaucguggacagaggaaaucggagcggcuacucuggcauuuucuccgucgagggaaagagcuguaucaacagaugcuuuuauguggaacugauucgcgggcggaaggaggaaaccgagguucucuggaccuccaauucuaucguggucuucuguggcacaagcgggaccuacggaacaggcuccuggcccgauggggcugacauuaaccugaugccuaucuga

SEQ ID NO: 202794 - RNA, 1410 nt, Artificial Sequence
  derived and/or modified sequence opt5 from neuraminidase__InfluenzaA__ADM95730
augaaccccaaucagaagaucauuaccaucggcagcgugucccugacaauuucuacgaucugcuucuuuaugcaaauugccauccucaucaccacagucacccugcacuucaaacaguacgaguuuaacagcccuccguccaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacaauaccguucgggaucgcacgccguauagaacacuccugaugaacgaacugggcgugcccuuucaccucgggaccaagcaggucugcauugccuggucuagcuccagcugucaugacggaaaagccuggcugcacgugugcaucacaggcgaugacaagaaugcuaccgccucuuucauuuacaacggccggcuuguugauuccguggucagcuggucuaaagagauccugcgcacccaggaauccgagugugugugcauuaaugggacauguacgguggucaugaccgacggaagcgcuuccggcaaggccgauacaaaaauccucuuuaucgaggaagggaagauuguucauaccucuacacugagcggauccgcgcaacacguggaggaaugcagcugcuauccuagauaccccggcgugcggugugucugccgcgacaacuggaaggggucuaacagaccuaucguggauauuaauaucaaagaccacuccauuguuagcucuuacguguguagcggacuugucggcgacacgccccggaagaacgauuccucuagcuccagccauugccuggacccgaauaacgaggaaggcgggcacggagugaaaggcugggccuucgaugacgggaaugauguuuggaugggacgcaccaucucugagaaguccagacucggcuaugagacauuuaaagugaucgaaggguggagcaacccuaagucuaaacugcagauuaaucggcaggucaucguggaccgcggaaacagauccggcuacagcggcauuuucuccgucgaggggaagucuuguaucaaucggugcuuuuauguggaacugauuagaggacgcaaggaggaaaccgagguucucuggaccagcaacuccaucguggucuucuguggcacaucugggaccuacggaacaggcagcuggcccgauggggcugacauuaaucugaugccuaucuga

SEQ ID NO: 202795 - RNA, 1410 nt, Artificial Sequence
  derived and/or modified sequence opt5 from neuraminidase__InfluenzaA__ADM95732
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccggucuaucguguccagcuacguuuguucuggacuugugggcgauacgccccgcaagaacgacagcuccucuagcucccacugccuggauccgaauaacgaggaaggcgggcauggagucaaaggcugggccuucgacgaugggaaugacguguggaugggaagaaccaucagcgagaagucucggcucggcuaugagacauuuaaaguuauugaagggugguccaaccacaagagcaaacugcagaucaaucgccaggugauugucgauagaggaaaccggucuggcuacuccggcaucuucagcguggaggggaaguccuguauuaauagaugcuuuuaugucgaacugauccgcggacggaaggaggaaaccgaggugcucuggaccucuaacagcauuguuguguucuguggcacauccgggaccuacggaacaggcucuuggccugacggggcugauaucaaucugaugcccaucuga

SEQ ID NO: 202796 - RNA, 1410 nt, Artificial Sequence; identical to SEQ ID NO: 199623
  derived and/or modified sequence opt5 from neuraminidase__InfluenzaA__ADM95733

SEQ ID NO: 202797 - RNA, 1410 nt, Artificial Sequence; identical to SEQ ID NO: 199623
  derived and/or modified sequence opt5 from neuraminidase__InfluenzaA__ADM95734

SEQ ID NO: 202798 - RNA, 1410 nt, Artificial Sequence; identical to SEQ ID NO: 199623
  derived and/or modified sequence opt5 from neuraminidase__InfluenzaA__ADM95735

SEQ ID NO: 202799 - RNA, 1410 nt, Artificial Sequence; identical to SEQ ID NO: 199623
  derived and/or modified sequence opt5 from neuraminidase__InfluenzaA__ADM95736

SEQ ID NO: 202800 - RNA, 1410 nt, Artificial Sequence
  derived and/or modified sequence opt5 from neuraminidase__InfluenzaA__ADM95737
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcagagccgauacaaagauccucuuuaucgaggaagggaaaauuguucauaccuccacacugucuggaagcgcgcaacacguggaggaaugcuccugcuauccucgguaccccggcgugcgcugugucugcagagacaacuggaaggggagcaaucggccuaucguggauauuaacaucaaggaccacucuauuguuuccagcuacguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucagcgagaaaucucggcucggcuaugagacauuuaaggugaucgaagggugguccaauccuaaaagcaagcugcagauuaaccgccaggucaucguggacagaggaaaucggucuggcuacuccggcauuuucagcgucgaggggaaauccuguaucaacagaugcuuuuauguggaacugauucgcggacggaaggaggaaaccgauguucucuggaccucuaauagcaucguggucuucuguggcacauccgggaccuacggaacaggcucuuggcccgacggggcugauauuaaccugaugccuaucuga

SEQ ID NO: 202801 - RNA, 1410 nt, Artificial Sequence; identical to SEQ ID NO: 199623
  derived and/or modified sequence opt5 from neuraminidase__InfluenzaA__ADM95738

SEQ ID NO: 202802 - RNA, 1410 nt, Artificial Sequence; identical to SEQ ID NO: 199623
  derived and/or modified sequence opt5 from neuraminidase__InfluenzaA__ADM95739

SEQ ID NO: 202803 - RNA, 1410 nt, Artificial Sequence
  derived and/or modified sequence opt5 from neuraminidase__InfluenzaA__ADM95740
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacgaugaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgaggggaaguccuguaucaaucggugcuuuuauguggaacugauuagaggacgcaaggaggaaaccaaaguucucuggaccucuaacagcaucguggucuucuguggcacauccgggaccuacggaacaggcucuuggcccgacggggcugauauuaaucugaugccuaucuga

SEQ ID NO: 202804 - RNA, 1410 nt, Artificial Sequence; identical to SEQ ID NO: 202779
  derived and/or modified sequence opt5 from neuraminidase__InfluenzaA__ADM95741

SEQ ID NO: 202805 - RNA, 1410 nt, Artificial Sequence; identical to SEQ ID NO: 199623
  derived and/or modified sequence opt5 from neuraminidase__InfluenzaA__ADM95742

SEQ ID NO: 202806 - RNA, 1410 nt, Artificial Sequence
  derived and/or modified sequence opt5 from neuraminidase__InfluenzaA__ADM95743
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggccggcuuguugauuccguggucagcuggucuaaagagauccugcgcacccaggaauccgagugugugugcauuaacgggacauguacgguggucaugaccgacggaagcgcuuccggcaaggccgauacaaaaauccucuuuaucgaggaagggaagauuguucauaccucuacacugagcggauccgcgcaacacguggaggaaugcagcugcuaucccagauacccuggcgugcggugugucugccgcgacaacuggaaggggucuaauagacccaucguggauauuaacaucaaagaccacuccauuguuagcucuuacguguguagcggacuugucggcgacaccccucggaagaaugauuccucuagcuccagccauugccuggaccccaacaaugaggaaggcgggcacggagugaaaggcugggccuucgaugacgggaacgauguuuggaugggacgcacgaucucugagaaguccagacucggcuaugagacauuuaaagugaucgaaggguggagcaauccgaagucuaaacugcagauuaaccggcaggucaucguggaccgcggaaauagauccggcuacagcggcauuuucuccgucgaggggaagucuuguaucaaccggugcuuuuauguggaacugauuagaggacgcaaggaggaaaccgagguucucuggaccagcaauuccaucguggucuucuguggcacaucugggaccuacggaacaggcagcuggccugauggggcugacauuaaccugaugcccaucuga

SEQ ID NO: 202807 - RNA, 1410 nt, Artificial Sequence; identical to SEQ ID NO: 199623
  derived and/or modified sequence opt5 from neuraminidase__InfluenzaA__ADM95744

SEQ ID NO: 202808 - RNA, 1410 nt, Artificial Sequence; identical to SEQ ID NO: 199762
  derived and/or modified sequence opt5 from neuraminidase__InfluenzaA__ADN05229

SEQ ID NO: 202809 - RNA, 1413 nt, Artificial Sequence; identical to SEQ ID NO: 200485
  derived and/or modified sequence opt5 from neuraminidase__InfluenzaA__ADN06292

SEQ ID NO: 202810 - RNA, 1413 nt, Artificial Sequence; identical to SEQ ID NO: 201954
  derived and/or modified sequence opt5 from neuraminidase__InfluenzaA__ADN06303

SEQ ID NO: 202811 - RNA, 1413 nt, Artificial Sequence
  derived and/or modified sequence opt5 from neuraminidase__InfluenzaA__ADN06314
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgaggucuucgugauucgcgaaccuuuuaucucuugcucccaccuggaguguagaacguucuuucucacccaaggcgcccugcuuaacgacaagcauagcaaugggacaguuaaagaucggucuccguaucgcgcccugauguccugcccccucggagaagcuccuagccccuacaacuccaaguucgagucuguggccuggagcgcuuccgccugucacgacggcaugggguggcugaccaucggaauuagcggcccugauaacggggcggucgccgugcugaaguauaauggaaucauuacaggcaccaucaaaucuuggaagaaacagauucucagaacgcaggaguccgaaugcguuuguaugaacggcagcugcuuuacaaucaugaccgacgggcccucuaauaaggcugccagcuacaaaaucuucaagauugagaagggaaaagugacaaaguccaucgaacugaacgcuccuaauuuuuauuacgaggaguguucuugcuacccggauaccggcauugucaugugugugugccgggacaacuggcaugggagcaaucgccccuggguguccuucaaccagaaucuugauuaucaaaucggauacauuugcagcggcgucuuuggggacaacccuagacccgaagauggagagggcucuuguaauccuguuaccguggacggcgccaacggggugaaaggauucuccuauaaguacggcaauggggucuggaucggacggacaaaaagcaaccgccugagaaagggcuuugaaaugauuugggaucccaauggguggacgaacaccgacucugacuucuccgugaaacaggauguuguggcgaucacagacuggagcggcuauuccggaucuuuuguccagcacccggagcucaccggccuggauugcauccggccuuguuucuggguggaacuuguucgcgggcugcccagagagaacacaaccauuuggacgagcggauccucuaucagcuucugcggcgugaauggggacacagccaacugguccuggccugauggagcugagcuccccuuuaccauugacaaguga

SEQ ID NO: 202812 - RNA, 1413 nt, Artificial Sequence; identical to SEQ ID NO: 201954
  derived and/or modified sequence opt5 from neuraminidase__InfluenzaA__ADN06325

SEQ ID NO: 202813 - RNA, 1413 nt, Artificial Sequence
  derived and/or modified sequence opt5 from neuraminidase__InfluenzaA__ADN06347
augaaccccaaucagaagaucauuaccaucggcagcauuuccaucgccauugggaucaucucucugaugcuccaaauuggaaacaucauuagcaucugggcuucccacucuauucagacagagagccagaauaacacgggcaucugcaaucagagaauuaucaccuacgaaaacuccacaugggugaaucauaccuaugucaacaucaauaacacaaauguuguggccggggaggacaaaaccucugugacacuggcgggaaacagcucccuuuguagcauuucuggcugggcuaucuacaccaaggauaauuccauucggaucgggagcaaaggagacgucuucgugauucgcgaaccuuuuaucucuugcucccaccuggaguguagaacguucuuucucacccaaggcgcccugcuuaacgauaagcauagcaauggcacaguuaaagaccggucuccguaucgcgcccugauguccugcccccucggggaagcuccuagccccuacaacuccaaguucgagucuguggccuggagcgcuuccgccugucacgauggaaugggcuggcugaccaucgggauuagcggaccugacaacggcgcggucgccgugcugaaguauaaugggaucauuacaggaaccaucaaaucuuggaagaaacagauucucagaacgcaggaguccgaaugcguuuguaugaacggcagcugcuuuacaaucaugaccgauggccccucuaauaaggcugccagcuacaaaaucuucaagauugagaaggggaaagugacaaaguccaucgaacugaacgcuccuaauuuuuauuacgaggaguguucuugcuacccggacaccggaauugucaugugugugugccgggauaacuggcauggcagcaaucgccccuggguguccuucaaccagaaucuugacuaucaaaugggguacaucugcagcggagucuuuggcgauaacccuagacccgaagacggggagggaucuuguaauccuguuaacguggauggcgccaauggcgugaaaggguucuccuauaaguacggaaacggcgucuggauugggcggaccaaaagcaaucgccugagaaagggauuugaaaugaucugggaccccaacggcuggacaaacacggacucugauuucuccgugaaacaggacguuguggcgauuaccgauuggagcggguauuccggcucuuuuguccagcacccggagcucacaggacuggacugcauccggccuuguuucuggguggaacuuguucgcggccugcccagagagaauaccacaaucuggaccagcggguccucuauuagcuucugcggagugaacuccgauacggccaauuggagcuggccugacggcgcugagcuccccuuuacaaucgauaaguga

SEQ ID NO: 202814 - RNA, 1410 nt, Artificial Sequence; identical to SEQ ID NO: 202434
  derived and/or modified sequence opt5 from neuraminidase__InfluenzaA__ADN06369

SEQ ID NO: 202815 - RNA, 1410 nt, Artificial Sequence; identical to SEQ ID NO: 199762
  derived and/or modified sequence opt5 from neuraminidase__InfluenzaA__ADN26031

SEQ ID NO: 202816 - RNA, 1410 nt, Artificial Sequence; identical to SEQ ID NO: 199762
  derived and/or modified sequence opt5 from neuraminidase__InfluenzaA__ADN26032

SEQ ID NO: 202817 - RNA, 1410 nt, Artificial Sequence; identical to SEQ ID NO: 199762
  derived and/or modified sequence opt5 from neuraminidase__InfluenzaA__ADN26033

SEQ ID NO: 202818 - RNA, 1410 nt, Artificial Sequence; identical to SEQ ID NO: 199762
  derived and/or modified sequence opt5 from neuraminidase__InfluenzaA__ADN26034

SEQ ID NO: 202819 - RNA, 1410 nt, Artificial Sequence; identical to SEQ ID NO: 199762
  derived and/or modified sequence opt5 from neuraminidase__InfluenzaA__ADN26035

SEQ ID NO: 202820 - RNA, 1410 nt, Artificial Sequence; identical to SEQ ID NO: 199762
  derived and/or modified sequence opt5 from neuraminidase__InfluenzaA__ADN26036

SEQ ID NO: 202821 - RNA, 1410 nt, Artificial Sequence
  derived and/or modified sequence opt5 from neuraminidase__InfluenzaA__ADN26037
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaucgauaaaaccggauccugcggcccggugagcucuaauggggccaacggaguuaagggcuucuccuuuaaguauggcaacgggguguggauuggaagaacaaaaagcaucuccucucggaauggcuucgagaugauuugggacccuaacggguggaccggaaccgauaauaacuuuagcaucaagcaagacaucgucggcauuaaugaaugguccggguacucuggcagcuucgugcagcaucccgagcuuacaggacuggacuguauccgcccuugcuucuggguugaacucauuagaggccggcccaaagagaacacgaucuggaccuccgggagcucuauuuccuuuuguggagugaauagcgauacagucggcuggucuuggcccgacggggcugagcugccuuucaccaucgauaaguga

SEQ ID NO: 202822 - RNA, 1410 nt, Artificial Sequence; identical to SEQ ID NO: 199762
  derived and/or modified sequence opt5 from neuraminidase__InfluenzaA__ADN26038

SEQ ID NO: 202823 - RNA, 1410 nt, Artificial Sequence; identical to SEQ ID NO: 199762
  derived and/or modified sequence opt5 from neuraminidase__InfluenzaA__ADN26041

SEQ ID NO: 202824 - RNA, 1410 nt, Artificial Sequence; identical to SEQ ID NO: 199762
  derived and/or modified sequence opt5 from neuraminidase__InfluenzaA__ADN26042

SEQ ID NO: 202825 - RNA, 1410 nt, Artificial Sequence
  derived and/or modified sequence opt5 from neuraminidase__InfluenzaA__ADN26043
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucaggucggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 202826 - RNA, 1410 nt, Artificial Sequence; identical to SEQ ID NO: 199762
  derived and/or modified sequence opt5 from neuraminidase__InfluenzaA__ADN26044

SEQ ID NO: 202827 - RNA, 1410 nt, Artificial Sequence; identical to SEQ ID NO: 199762
  derived and/or modified sequence opt5 from neuraminidase__InfluenzaA__ADN26045

SEQ ID NO: 202828 - RNA, 1410 nt, Artificial Sequence
  derived and/or modified sequence opt5 from neuraminidase__InfluenzaA__ADN26047
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcaugguguccgucaaacuuaccggaaauucuagccugugcccuguguccggcugggcgauuuacagcaaggacaacucuguuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugcuuggucugccagcgcuugccacgacggaaucaauuggcugacaauuggcaucuccgggccugauaacggagccguggcuguccugaaguauaauggcaucauuaccgacacaaucaagagcuggagaaacaauauucuccggacccaagagucugagugugccugcgugaacggguccuguuucacggugaugacagauggaccgagcaauggccaggcgucuuacaaaaucuuucgcauugaaaagggcaaaaucgucaagagcguugagaugaacgcccccaauuaucauuacgaagagugcuccuguuacccugacucuagcgagauuaccugcgugugcagagauaacuggcacggguccaaucggcccugggugagcuucaaccagaaucuggaauaucagaucggauacaucuguucuggcauuuuuggggacaacccucgccccaaugauaaaacaggauccugcggcccggucagcucuaacggggcuaacggagugaagggcuucuccuuuaaguauggcaaugggguuuggaucggaagaaccaaaagcauuuccucucggaacggcuucgagaugaucugggacccuaauggguggaccggaacagauaacaauuuuagcauuaagcaagacaucgugggcaucaacgaaugguccggguacucuggcagcuucguccagcaucccgagcuuacgggacuggacuguauucgcccuugcuucuggguggaacucaucagaggccggcccaaagagaauaccauuuggacauccgggagcucuaucuccuuuuguggaguuaacagcgauaccgugggcuggucuuggcccgacggggccgagcugccuuucacaauugauaaguga

SEQ ID NO: 202829 - RNA, 1410 nt, Artificial Sequence; identical to SEQ ID NO: 199762
  derived and/or modified sequence opt5 from neuraminidase__InfluenzaA__ADN26048

SEQ ID NO: 202830 - RNA, 1410 nt, Artificial Sequence; identical to SEQ ID NO: 199762
  derived and/or modified sequence opt5 from neuraminidase__InfluenzaA__ADN26049

SEQ ID NO: 202831 - RNA, 1410 nt, Artificial Sequence; identical to SEQ ID NO: 199762
  derived and/or modified sequence opt5 from neuraminidase__InfluenzaA__ADN26050

SEQ ID NO: 202832 - RNA, 1410 nt, Artificial Sequence; identical to SEQ ID NO: 199762
  derived and/or modified sequence opt5 from neuraminidase__InfluenzaA__ADN26051

SEQ ID NO: 202833 - RNA, 1410 nt, Artificial Sequence; identical to SEQ ID NO: 199762
  derived and/or modified sequence opt5 from neuraminidase__InfluenzaA__ADN26052

SEQ ID NO: 202834 - RNA, 1410 nt, Artificial Sequence; identical to SEQ ID NO: 199752
  derived and/or modified sequence opt5 from neuraminidase__InfluenzaA__ADN26053

SEQ ID NO: 202835 - RNA, 1410 nt, Artificial Sequence; identical to SEQ ID NO: 199762
  derived and/or modified sequence opt5 from neuraminidase__InfluenzaA__ADN26054

SEQ ID NO: 202836 - RNA, 1410 nt, Artificial Sequence; identical to SEQ ID NO: 199762
  derived and/or modified sequence opt5 from neuraminidase__InfluenzaA__ADN26057

SEQ ID NO: 202837 - RNA, 1410 nt, Artificial Sequence; identical to SEQ ID NO: 199762
  derived and/or modified sequence opt5 from neuraminidase__InfluenzaA__ADN26058

SEQ ID NO: 202838 - RNA, 1410 nt, Artificial Sequence; identical to SEQ ID NO: 199762
  derived and/or modified sequence opt5 from neuraminidase__InfluenzaA__ADN26059

SEQ ID NO: 202839 - RNA, 1410 nt, Artificial Sequence; identical to SEQ ID NO: 200129
  derived and/or modified sequence opt5 from neuraminidase__InfluenzaA__ADN26060

SEQ ID NO: 202840 - RNA, 1410 nt, Artificial Sequence; identical to SEQ ID NO: 199762
  derived and/or modified sequence opt5 from neuraminidase__InfluenzaA__ADN26061

SEQ ID NO: 202841 - RNA, 1410 nt, Artificial Sequence; identical to SEQ ID NO: 199762
  derived and/or modified sequence opt5 from neuraminidase__InfluenzaA__ADN26063

SEQ ID NO: 202842 - RNA, 1410 nt, Artificial Sequence; identical to SEQ ID NO: 199762
  derived and/or modified sequence opt5 from neuraminidase__InfluenzaA__ADN26064

SEQ ID NO: 202843 - RNA, 1410 nt, Artificial Sequence; identical to SEQ ID NO: 200835
  derived and/or modified sequence opt5 from neuraminidase__InfluenzaA__ADN26065

SEQ ID NO: 202844 - RNA, 1410 nt, Artificial Sequence; identical to SEQ ID NO: 199762
  derived and/or modified sequence opt5 from neuraminidase__InfluenzaA__ADN26066

SEQ ID NO: 202845 - RNA, 1410 nt, Artificial Sequence; identical to SEQ ID NO: 199762
  derived and/or modified sequence opt5 from neuraminidase__InfluenzaA__ADN26067

SEQ ID NO: 202846 - RNA, 1410 nt, Artificial Sequence; identical to SEQ ID NO: 199762
  derived and/or modified sequence opt5 from neuraminidase__InfluenzaA__ADN26069

SEQ ID NO: 202847 - RNA, 1410 nt, Artificial Sequence; identical to SEQ ID NO: 199762
  derived and/or modified sequence opt5 from neuraminidase__InfluenzaA__ADN26070

SEQ ID NO: 202848 - RNA, 1410 nt, Artificial Sequence; identical to SEQ ID NO: 199762
  derived and/or modified sequence opt5 from neuraminidase__InfluenzaA__ADN26072

SEQ ID NO: 202849 - RNA, 1410 nt, Artificial Sequence; identical to SEQ ID NO: 199762
  derived and/or modified sequence opt5 from neuraminidase__InfluenzaA__ADN26073

SEQ ID NO: 202850 - RNA, 1410 nt, Artificial Sequence; identical to SEQ ID NO: 199762
  derived and/or modified sequence opt5 from neuraminidase__InfluenzaA__ADN26075

SEQ ID NO: 202851 - RNA, 1410 nt, Artificial Sequence; identical to SEQ ID NO: 199762
  derived and/or modified sequence opt5 from neuraminidase__InfluenzaA__ADN26076

SEQ ID NO: 202852 - RNA, 1410 nt, Artificial Sequence; identical to SEQ ID NO: 199762
  derived and/or modified sequence opt5 from neuraminidase__InfluenzaA__ADN26077

SEQ ID NO: 202853 - RNA, 1410 nt, Artificial Sequence; identical to SEQ ID NO: 199762
  derived and/or modified sequence opt5 from neuraminidase__InfluenzaA__ADN26078

SEQ ID NO: 202854 - RNA, 1410 nt, Artificial Sequence; identical to SEQ ID NO: 199762
  derived and/or modified sequence opt5 from neuraminidase__InfluenzaA__ADN26079

SEQ ID NO: 202855 - RNA, 1410 nt, Artificial Sequence; identical to SEQ ID NO: 199762
  derived and/or modified sequence opt5 from neuraminidase__InfluenzaA__ADN26080

SEQ ID NO: 202856 - RNA, 1410 nt, Artificial Sequence; identical to SEQ ID NO: 199762
  derived and/or modified sequence opt5 from neuraminidase__InfluenzaA__ADN26081

SEQ ID NO: 202857 - RNA, 1410 nt, Artificial Sequence; identical to SEQ ID NO: 199762
  derived and/or modified sequence opt5 from neuraminidase__InfluenzaA__ADN26082

SEQ ID NO: 202858 - RNA, 1410 nt, Artificial Sequence; identical to SEQ ID NO: 199762
  derived and/or modified sequence opt5 from neuraminidase__InfluenzaA__ADN26083

SEQ ID NO: 202859 - RNA, 1410 nt, Artificial Sequence; identical to SEQ ID NO: 201664
  derived and/or modified sequence opt5 from neuraminidase__InfluenzaA__ADN26084

SEQ ID NO: 202860 - RNA, 1410 nt, Artificial Sequence; identical to SEQ ID NO: 199762
  derived and/or modified sequence opt5 from neuraminidase__InfluenzaA__ADN26085

SEQ ID NO: 202861 - RNA, 1410 nt, Artificial Sequence; identical to SEQ ID NO: 199762
  derived and/or modified sequence opt5 from neuraminidase__InfluenzaA__ADN26086

SEQ ID NO: 202862 - RNA, 1410 nt, Artificial Sequence; identical to SEQ ID NO: 199762
  derived and/or modified sequence opt5 from neuraminidase__InfluenzaA__ADN26087

SEQ ID NO: 202863 - RNA, 1410 nt, Artificial Sequence; identical to SEQ ID NO: 199762
  derived and/or modified sequence opt5 from neuraminidase__InfluenzaA__ADN26088

SEQ ID NO: 202864 - RNA, 1410 nt, Artificial Sequence; identical to SEQ ID NO: 199762
  derived and/or modified sequence opt5 from neuraminidase__InfluenzaA__ADN26090

SEQ ID NO: 202865 - RNA, 1410 nt, Artificial Sequence; identical to SEQ ID NO: 199762
  derived and/or modified sequence opt5 from neuraminidase__InfluenzaA__ADN26091

SEQ ID NO: 202866 - RNA, 1410 nt, Artificial Sequence; identical to SEQ ID NO: 199762
  derived and/or modified sequence opt5 from neuraminidase__InfluenzaA__ADN26092

SEQ ID NO: 202867 - RNA, 1410 nt, Artificial Sequence; identical to SEQ ID NO: 199762
  derived and/or modified sequence opt5 from neuraminidase__InfluenzaA__ADN26093

SEQ ID NO: 202868 - RNA, 1410 nt, Artificial Sequence
  derived and/or modified sequence opt5 from neuraminidase__InfluenzaA__ADN26094
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaaggacaauaacuuuagcaucaaacaagacaucgugggcauuaaugaaugguccggguacucuggcagcuucguccagcaucccgagcuuaccggacuggauuguauccgcccuugcuucuggguggaacucauuagaggccggcccaaggagaacacaaucuggacguccgggagcucuauuuccuuuuguggaguuaauagcgacaccgugggcuggucuuggcccgauggggcugagcugccuuucacaaucgacaaauga

SEQ ID NO: 202869 - RNA, 1410 nt, Artificial Sequence; identical to SEQ ID NO: 201664
  derived and/or modified sequence opt5 from neuraminidase__InfluenzaA__ADN26095

SEQ ID NO: 202870 - RNA, 1410 nt, Artificial Sequence
  derived and/or modified sequence opt5 from neuraminidase__InfluenzaA__ADN26096
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaaccaaaaacaucuccagccggaauggcuucgagaugauuugggauccuaacggguggacaggaaccgacaauaacuuuuccaucaagcaagacaucgugggcauuaaugaauggucuggguacagcggcuccuucguccagcaucccgagcuuacaggacuggauuguauccgcccuugcuucuggguggaacucauuagaggccggcccaaagagaacacgaucuggaccucugggagcuccauuagcuuuuguggaguuaauucugacacagugggcugguccuggcccgauggggcugagcugccuuucaccaucgacaaguga

SEQ ID NO: 202871 - RNA, 1410 nt, Artificial Sequence; identical to SEQ ID NO: 199762
  derived and/or modified sequence opt5 from neuraminidase__InfluenzaA__ADN26097

SEQ ID NO: 202872 - RNA, 1410 nt, Artificial Sequence; identical to SEQ ID NO: 199762
  derived and/or modified sequence opt5 from neuraminidase__InfluenzaA__ADN26098

SEQ ID NO: 202873 - RNA, 1410 nt, Artificial Sequence; identical to SEQ ID NO: 199762
  derived and/or modified sequence opt5 from neuraminidase__InfluenzaA__ADN26099

SEQ ID NO: 202874 - RNA, 1410 nt, Artificial Sequence; identical to SEQ ID NO: 199762
  derived and/or modified sequence opt5 from neuraminidase__InfluenzaA__ADN26100

SEQ ID NO: 202875 - RNA, 1410 nt, Artificial Sequence; identical to SEQ ID NO: 199762
  derived and/or modified sequence opt5 from neuraminidase__InfluenzaA__ADN26101

SEQ ID NO: 202876 - RNA, 1410 nt, Artificial Sequence
  derived and/or modified sequence opt5 from neuraminidase__InfluenzaA__ADN26102
augaaccccaaucagaagaucauuaccaucggcagcgugugcaugacaauugggauggccaaccugauccuccaaauuggaaauaucaucuccauuuggaucucucaccugauucagcuuggcaaccagaaucagaucgagacguguaaccaaagcgucauuaccuacgaaaauaacacauggguuaaucagaccuaugugaacaucuccaauacaaacuucgcugccgggcagucuguggucagcgugaaacuggcgggaaauuccucucucugcccuguuagcggcugggcuauuuacuccaaggacaacagcaucagaaucgggucuaaaggagauguguuugucauucgggagccguucaucuccuguagcccccuggaaugccgcaccuuuuuccuuacacagggcgcccugcucaaugacaagcauucuaacggcaccauuaaagauagauccccuuaucggacgcugaugagcugucccaucggggaggugccuucucccuacaacucccgcuuugaaagcguugccugguccgcuucugccugccacgacggaauuaauuggcugaccaucggcaucagcgggccugauaacggagcuguggccguccucaaguauaauggcauuaucacagacaccauuaaguccuggagaaacaauauccugcggacacaagagagcgagugugcgugcgugaacgggucuuguuucaccgugaugacggauggaccguccgacggccaggccagcuacaaaauuuuuaagaucgaaaaaggcaagaucgucaaaucuguugagaugaaugcucccaacuaucauuacgaagagugcagcuguuacccugauuccucugagauuacaugcgugugccgcgacaauuggcacgggagcaacagacccuggguguccuucaaucagaaccuugaauaucagaucggauacauuuguagcggcaucuuuggggauaauccucggcccaacgacaagaccggaucuugcggcccggucuccagcaauggggccaacggagugaagggcuucucuuuuaaauauggcaacgggguuuggauuggacgcacaaaguccaucagcuccagaaauggcuucgagaugauuugggauccuaacggguggaccggaaccgacaauaacuuuucuaucaaacaagacaucgugggcauuaaugaauggagcggguacuccggcucuuucguccagcaucccgagcugacaggacucgauuguauccggccuugcuucuggguggaacugauucgcggcagacccaaggagaacagcaucuggacguccgggagcucuauuuccuuuuguggaguuaauagcgacaccgugggcuggucuuggcccgauggggcugagcuuccuuucacaaucgacaaauga

SEQ ID NO: 202877 - RNA, 1410 nt, Artificial Sequence; identical to SEQ ID NO: 199762
  derived and/or modified sequence opt5 from neuraminidase__InfluenzaA__ADN26103

SEQ ID NO: 202878 - RNA, 1410 nt, Artificial Sequence; identical to SEQ ID NO: 199762
  derived and/or modified sequence opt5 from neuraminidase__InfluenzaA__ADN26104

SEQ ID NO: 202879 - RNA, 1410 nt, Artificial Sequence; identical to SEQ ID NO: 199762
  derived and/or modified sequence opt5 from neuraminidase__InfluenzaA__ADN26105

SEQ ID NO: 202880 - RNA, 1410 nt, Artificial Sequence; identical to SEQ ID NO: 199762
  derived and/or modified sequence opt5 from neuraminidase__InfluenzaA__ADN26106

SEQ ID NO: 202881 - RNA, 1410 nt, Artificial Sequence; identical to SEQ ID NO: 201664
  derived and/or modified sequence opt5 from neuraminidase__InfluenzaA__ADN26107

SEQ ID NO: 202882 - RNA, 1410 nt, Artificial Sequence; identical to SEQ ID NO: 201664
  derived and/or modified sequence opt5 from neuraminidase__InfluenzaA__ADN26108

SEQ ID NO: 202883 - RNA, 1410 nt, Artificial Sequence; identical to SEQ ID NO: 199762
  derived and/or modified sequence opt5 from neuraminidase__InfluenzaA__ADN26109

SEQ ID NO: 202884 - RNA, 1410 nt, Artificial Sequence; identical to SEQ ID NO: 200736
  derived and/or modified sequence opt5 from neuraminidase__InfluenzaA__ADN26110

SEQ ID NO: 202885 - RNA, 1410 nt, Artificial Sequence; identical to SEQ ID NO: 201664
  derived and/or modified sequence opt5 from neuraminidase__InfluenzaA__ADN26111

SEQ ID NO: 202886 - RNA, 1410 nt, Artificial Sequence; identical to SEQ ID NO: 200736
  derived and/or modified sequence opt5 from neuraminidase__InfluenzaA__ADN26112

SEQ ID NO: 202887 - RNA, 1410 nt, Artificial Sequence; identical to SEQ ID NO: 201664
  derived and/or modified sequence opt5 from neuraminidase__InfluenzaA__ADN26113

SEQ ID NO: 202888 - RNA, 1410 nt, Artificial Sequence
  derived and/or modified sequence opt5 from neuraminidase__InfluenzaA__ADN26114
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucaauaacacaaauuucgcugccgggcagucuguggucagcgugaaacuugcgggaaacuccucucugugcccuguuagcggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 202889 - RNA, 1410 nt, Artificial Sequence; identical to SEQ ID NO: 199762
  derived and/or modified sequence opt5 from neuraminidase__InfluenzaA__ADN26115

SEQ ID NO: 202890 - RNA, 1410 nt, Artificial Sequence
  derived and/or modified sequence opt5 from neuraminidase__InfluenzaA__ADN26116
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacacgccuggauuguaucagaccuugcuucuggguggaacucauucggggacgccccaaagagaauacgaucuggaccagcggcuccagcauuucuuuuugugggguuaacuccgacacagugggauggagcuggcccgauggcgcugagcugccuuucaccaucgacaaguga

SEQ ID NO: 202891 - RNA, 1410 nt, Artificial Sequence; identical to SEQ ID NO: 201664
  derived and/or modified sequence opt5 from neuraminidase__InfluenzaA__ADN26117

SEQ ID NO: 202892 - RNA, 1410 nt, Artificial Sequence; identical to SEQ ID NO: 201664
  derived and/or modified sequence opt5 from neuraminidase__InfluenzaA__ADN26118

SEQ ID NO: 202893 - RNA, 1410 nt, Artificial Sequence; identical to SEQ ID NO: 199762
  derived and/or modified sequence opt5 from neuraminidase__InfluenzaA__ADN26119

SEQ ID NO: 202894 - RNA, 1410 nt, Artificial Sequence; identical to SEQ ID NO: 200736
  derived and/or modified sequence opt5 from neuraminidase__InfluenzaA__ADN26120

SEQ ID NO: 202895 - RNA, 1410 nt, Artificial Sequence; identical to SEQ ID NO: 201664
  derived and/or modified sequence opt5 from neuraminidase__InfluenzaA__ADN26121

SEQ ID NO: 202896 - RNA, 1410 nt, Artificial Sequence; identical to SEQ ID NO: 199762
  derived and/or modified sequence opt5 from neuraminidase__InfluenzaA__ADN26122

SEQ ID NO: 202897 - RNA, 1410 nt, Artificial Sequence; identical to SEQ ID NO: 199762
  derived and/or modified sequence opt5 from neuraminidase__InfluenzaA__ADN26123

SEQ ID NO: 202898 - RNA, 1410 nt, Artificial Sequence; identical to SEQ ID NO: 199762
  derived and/or modified sequence opt5 from neuraminidase__InfluenzaA__ADN26124

SEQ ID NO: 202899 - RNA, 1410 nt, Artificial Sequence; identical to SEQ ID NO: 200736
  derived and/or modified sequence opt5 from neuraminidase__InfluenzaA__ADN26125

SEQ ID NO: 202900 - RNA, 1410 nt, Artificial Sequence; identical to SEQ ID NO: 200736
  derived and/or modified sequence opt5 from neuraminidase__InfluenzaA__ADN26126

SEQ ID NO: 202901 - RNA, 1410 nt, Artificial Sequence; identical to SEQ ID NO: 200527
  derived and/or modified sequence opt5 from neuraminidase__InfluenzaA__ADN26127

SEQ ID NO: 202902 - RNA, 1410 nt, Artificial Sequence; identical to SEQ ID NO: 199762
  derived and/or modified sequence opt5 from neuraminidase__InfluenzaA__ADN26128

SEQ ID NO: 202903 - RNA, 1410 nt, Artificial Sequence; identical to SEQ ID NO: 200736
  derived and/or modified sequence opt5 from neuraminidase__InfluenzaA__ADN26129

SEQ ID NO: 202904 - RNA, 1410 nt, Artificial Sequence; identical to SEQ ID NO: 201664
  derived and/or modified sequence opt5 from neuraminidase__InfluenzaA__ADN26130

SEQ ID NO: 202905 - RNA, 1410 nt, Artificial Sequence
  derived and/or modified sequence opt5 from neuraminidase__InfluenzaA__ADN26131
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaagggauccugcggcccggucagcucuaauggggccaacggagugaagggcuucuccuuuaaauauggcaacgggguuuggauuggaagaaccaagagcaucuccucucggaauggcuucgagaugauuugggauccuaacggguggacaggaaccgacaauaacuuuagcaucaaacaagacaucgugggcauuaaugaaugguccggguacucuggcagcuucguccagcaucccgagcuuaccggacuggauuguauccgcccuugcuucuggguggaacucauuagaggccggcccaaggagaacacaaucuggacguccgggagcucuauuucccuguguggaguuaauagcgacaccgugggcuggucuuggcccgauggggcugagcuuccuuuuacaaucgacaaauga

SEQ ID NO: 202906 - RNA, 1410 nt, Artificial Sequence; identical to SEQ ID NO: 201664
  derived and/or modified sequence opt5 from neuraminidase__InfluenzaA__ADN26132

SEQ ID NO: 202907 - RNA, 1410 nt, Artificial Sequence; identical to SEQ ID NO: 200736
  derived and/or modified sequence opt5 from neuraminidase__InfluenzaA__ADN26134

SEQ ID NO: 202908 - RNA, 1410 nt, Artificial Sequence; identical to SEQ ID NO: 199762
  derived and/or modified sequence opt5 from neuraminidase__InfluenzaA__ADN26135

SEQ ID NO: 202909 - RNA, 1410 nt, Artificial Sequence; identical to SEQ ID NO: 199762
  derived and/or modified sequence opt5 from neuraminidase__InfluenzaA__ADN26136

SEQ ID NO: 202910 - RNA, 1410 nt, Artificial Sequence; identical to SEQ ID NO: 199762
  derived and/or modified sequence opt5 from neuraminidase__InfluenzaA__ADN26137

SEQ ID NO: 202911 - RNA, 1410 nt, Artificial Sequence; identical to SEQ ID NO: 201664
  derived and/or modified sequence opt5 from neuraminidase__InfluenzaA__ADN26138

SEQ ID NO: 202912 - RNA, 1410 nt, Artificial Sequence; identical to SEQ ID NO: 200736
  derived and/or modified sequence opt5 from neuraminidase__InfluenzaA__ADN26140

SEQ ID NO: 202913 - RNA, 1410 nt, Artificial Sequence
  derived and/or modified sequence opt5 from neuraminidase__InfluenzaA__ADN26141
augaaccccaaucagaagaucauuaccaucggcagcgugugcaugacaauugggauggccaaccugauccuccaaauuggaaauaucaucuccauuuggaucucucacagcauucagcugggcaaccagaauagaaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuauccggaucggguccaaaggagauguguuugucauucgcgagccguucaucagcuguucuccccucgaaugcagaaccuuuuuccugacacagggcgcccuucugaaugacaagcauuccaacggcaccauuaaagaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaguauaauggcauuaucacagacaccauuaagagcuggcggaacaauauccuccgcacacaggagucugagugugcgugcgugaacggguccuguuucaccgugaugacggauggaccgagcgacggccaagccucuuacaaaauuuuuagaaucgaaaagggcaaaaucgucaagagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucgugggcauuaaugaaugguccggguacucuggcagcuucguccaacaucccgagcuuacaggacuggauuguaucagaccuugcuucuggguggaacucauucggggccgccccaaagagaacacgaucuggaccuccgggagcucuauuuccuuuuguggaguuaauagcgacacagugggcuggucuuggcccgauggggcugagcugccuuucaccaucgacaaguga

SEQ ID NO: 202914 - RNA, 1410 nt, Artificial Sequence
  derived and/or modified sequence opt5 from neuraminidase__InfluenzaA__ADN26142
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauaacaauuucgcugccgggcagagcguggucuccgugaaacuugcgggaaacucuagccugugcccuguuaauggcugggcuauuuacuccaaggacaacagcaucagaaucgggucuaaaggagauguguuugucauucgggagccguucaucuccuguagcccccucgaaugccgcacauuuuuccugacccagggcgcccuucugaacgacaagcauucuaauggcacaauuaaagauagauccccuuaucggacccucaugagcugucccaucggggaggugccuucucccuacaacucccgcuuugaaagcguugccugguccgcuucugccugccacgacggaauuaauuggcugacgaucggcaucagcgggccugauaacggagcuguggccguccugaaguauaauggcauuaucaccgacacaauuaaguccuggagaaacaauauccuccggacccaagagagcgagugugcgugcgugaacgggucuuguuucacagugaugaccgauggaccguccgacggccaggccagcuacaaaauuuuucgcaucgaaaagggcaaaaucgucaagucuguugagaugaaugcucccaacuaucauuacgaagagugcagcuguuacccugauuccucugagauuacgugcgugugcagagacaauuggcacgggagcaaccggcccuggguguccuucaaucagaaccuggaauaucagaucggauacauuuguagcggcaucuuuggggauaauccucgccccaacgacaaaacaggaucuugcggcccggucuccagcaacggggccaauggagugaagggcuucucuuuuaaguauggcaacgggguuuggauuggaagaaccaaauccaucagcucccggaauggcuucgagaugauuugggauccuaacggguggacaggaaccgacaauaacuuuucuaucaagcaagacaucgugggcauuaaugaauggagcggguacuccggcucuuucguccagcaucccgagcuuaccggacuggauuguauccgcccuugcuucuggguggaacucauuagaggccggcccaaagagaacacaaucuggacgagcggguccagcauuucuuuuuguggaguuaauuccgacaccgugggcuggagcuggcccgauggggcugagcugccuuucacaaucgacaaguga

SEQ ID NO: 202915 - RNA, 1410 nt, Artificial Sequence; identical to SEQ ID NO: 199762
  derived and/or modified sequence opt5 from neuraminidase__InfluenzaA__ADN26143

SEQ ID NO: 202916 - RNA, 1410 nt, Artificial Sequence; identical to SEQ ID NO: 201664
  derived and/or modified sequence opt5 from neuraminidase__InfluenzaA__ADN26144

SEQ ID NO: 202917 - RNA, 1410 nt, Artificial Sequence; identical to SEQ ID NO: 201664
  derived and/or modified sequence opt5 from neuraminidase__InfluenzaA__ADN26145

SEQ ID NO: 202918 - RNA, 1410 nt, Artificial Sequence; identical to SEQ ID NO: 199762
  derived and/or modified sequence opt5 from neuraminidase__InfluenzaA__ADN26146

SEQ ID NO: 202919 - RNA, 1410 nt, Artificial Sequence; identical to SEQ ID NO: 201664
  derived and/or modified sequence opt5 from neuraminidase__InfluenzaA__ADN26147

SEQ ID NO: 202920 - RNA, 1410 nt, Artificial Sequence; identical to SEQ ID NO: 199762
  derived and/or modified sequence opt5 from neuraminidase__InfluenzaA__ADN26148

SEQ ID NO: 202921 - RNA, 1410 nt, Artificial Sequence; identical to SEQ ID NO: 201664
  derived and/or modified sequence opt5 from neuraminidase__InfluenzaA__ADN26149

SEQ ID NO: 202922 - RNA, 1410 nt, Artificial Sequence
  derived and/or modified sequence opt5 from neuraminidase__InfluenzaA__ADN26150
augaaccccaaucagaagaucauuaccaucggcagcgugugcaugacaauugggauggccucccugauccuccaaauuggaaacaucaucucuauuuggaucagccacuccauucagcugggcaaucagaaccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 202923 - RNA, 1410 nt, Artificial Sequence; identical to SEQ ID NO: 200736
  derived and/or modified sequence opt5 from neuraminidase__InfluenzaA__ADN26151

SEQ ID NO: 202924 - RNA, 1410 nt, Artificial Sequence
  derived and/or modified sequence opt5 from neuraminidase__InfluenzaA__ADN26152
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccaugaaacuugcgggaaauucuagccugugcccugugaacggcugggcuauuuacuccaaggacaauagcaucagaaucgggucuaaaggagauguuuuugugauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggucccuucucccuacaauucccgcuuugaaagcguggccugguccgcuucugccugccacgacggaauuaacuggcugaccaucggcaucagcgggccugauaauggagcuguugccgugcugaaguauaacggcauuaucacagacaccauuaaguccuggagaaauaacauccuccggacacaagagagcgagugugcgugcgucaaugggucuuguuucaccgugaugacggauggaccguccgacggccaggccagcuacaaaauuuuucgcaucgaaaagggcaaaaucgugaagucugucgagaugaacgcucccaauuaucauuacgaagagugcagcuguuacccugauuccucugagauuacaugcguuugcagagacaacuggcacgggagcaaucggcccuggguguccuucaaccagaaucuggaauaucagaucggauacauuuguagcggcaucuuuggggauaacccucgccccaaugacaaaaccggaucuugcggcccgguguccagcaacggggccaacggagucaagggcuucucuuuuaaguauggcaaugggguguggauuggaagaacaaaauccaucagcucccggaacggcuucgagaugauuugggauccuaauggguggacccgcaccgacaacaauuuuucuaucaagcaagacaucguuggaauuaacgaauggagcggcuacuccgggucuuucgugcagcaucccgagcuuacaggccuggauuguaucagaccuugcuucugggucgaacucauucggggacgccccaaagagaauacgaucuggaccagcggcuccagcauuucuuuuuguggggugaacuccgacacaguuggauggagcuggcccgauggcgcugagcugccuuucaccaucgacaaguga

SEQ ID NO: 202925 - RNA, 1410 nt, Artificial Sequence; identical to SEQ ID NO: 201664
  derived and/or modified sequence opt5 from neuraminidase__InfluenzaA__ADN26153

SEQ ID NO: 202926 - RNA, 1410 nt, Artificial Sequence; identical to SEQ ID NO: 200345
  derived and/or modified sequence opt5 from neuraminidase__InfluenzaA__ADN26154

SEQ ID NO: 202927 - RNA, 1410 nt, Artificial Sequence; identical to SEQ ID NO: 199762
  derived and/or modified sequence opt5 from neuraminidase__InfluenzaA__ADN26155

SEQ ID NO: 202928 - RNA, 1410 nt, Artificial Sequence; identical to SEQ ID NO: 200736
  derived and/or modified sequence opt5 from neuraminidase__InfluenzaA__ADN26157

SEQ ID NO: 202929 - RNA, 1410 nt, Artificial Sequence; identical to SEQ ID NO: 199762
  derived and/or modified sequence opt5 from neuraminidase__InfluenzaA__ADN26159

SEQ ID NO: 202930 - RNA, 1410 nt, Artificial Sequence; identical to SEQ ID NO: 199762
  derived and/or modified sequence opt5 from neuraminidase__InfluenzaA__ADN26161

SEQ ID NO: 202931 - RNA, 1410 nt, Artificial Sequence
  derived and/or modified sequence opt5 from neuraminidase__InfluenzaA__ADN26162
augaaccccaaucagaagaucauuaccaucagcuccgugugcaugacagucggcauggccaaccugauucuccaaaucgggaauauuaucucuaucuggauuagccacuccauccagcugggaaaccagaaucagauugagacguguaaccaaucuguuaucaccuacgaaaauaacacaugggugaaucagaccuaugugaacauuagcaauacaaacuucgcugccggccaguccgucgugucuguuaaacuugcggggaauagcucccugugcccugugagcggaugggcuaucuacucuaaggacaacuccauuagaaucggcagcaaaggggaugucuuugugauccgggagccguucauuucuuguucuccccucgaaugccgcaccuuuuuccugacacagggagcccuucugaaugacaagcauagcaacggcaccaucaaagauagaucuccuuaucggacgcucauguccugucccauuggcgagguuccuagccccuacaacucccgcuuugaaucuguggccuggagcgcuuccgccugccacgacgggaucaauuggcugaccauuggaaucagcggcccugauaacggggcugucgccgugcugaaguauaauggaaucauuacagacaccaucaagucuuggagaaacaauauucuccggacacaagaguccgagugugcgugcgugaacggcagcuguuucaccgucaugacggaugggccgucugacggacaggccagcuacaaaaucuuucgcauugaaaagggcaaaaucguuaaguccguggagaugaaugcucccaacuaucauuacgaagagugcucuuguuacccugauagcuccgagaucacaugcgugugcagagacaauuggcacggcagcaaccggcccugggucucuuucaaucagaaccuggaauaucagauuggguacaucuguuccggaauuuuuggcgauaauccucgccccaacgacaaaaccgggagcugcggaccggugucuuccaauggcgccaacgggguuaagggauucagcuuuaaguauggcaacggcguguggaucgggagaacaaaauccauuucuagccggaauggauucgagaugaucugggauccuaacggcuggaccgggaccgacaauaacuuuuccauuaagcaagacaucgucggaaucaaugaauggucuggcuacagcggguccuucgugcagcaucccgagcuuacaggccuggauuguauucgcccuugcuucuggguugaacucaucagaggacggcccaaagagaacacgauuuggaccagcggcuccuccaucagcuuuuguggggucaauucugacacagugggaugguccuggcccgauggcgcugagcugccuuucaccauugacaaguga

SEQ ID NO: 202932 - RNA, 1410 nt, Artificial Sequence
  derived and/or modified sequence opt5 from neuraminidase__InfluenzaA__ADN26163
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucauuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaucauugacaaguga

SEQ ID NO: 202933 - RNA, 1410 nt, Artificial Sequence
  derived and/or modified sequence opt5 from neuraminidase__InfluenzaA__ADN26164
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugccugaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuugaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaaugacuuuagcaucaagcaagauaucguuggcauuaacgaaugguccggguacucuggcagcuucgugcagcaucccgagcugacaggacucgacuguauccgcccuugcuucugggucgaacugauuagaggccggcccaaagagaauacgaucuggaccuccgggagcucuauuuccuuuuguggagugaacagcgauacaguuggcuggucuuggcccgacggggcugagcuuccuuucaccaucgauaaguga

SEQ ID NO: 202934 - RNA, 1410 nt, Artificial Sequence; identical to SEQ ID NO: 201719
  derived and/or modified sequence opt5 from neuraminidase__InfluenzaA__ADN26168

SEQ ID NO: 202935 - RNA, 1410 nt, Artificial Sequence; identical to SEQ ID NO: 200985
  derived and/or modified sequence opt5 from neuraminidase__InfluenzaA__ADN26178

SEQ ID NO: 202936 - RNA, 1410 nt, Artificial Sequence; identical to SEQ ID NO: 199762
  derived and/or modified sequence opt5 from neuraminidase__InfluenzaA__ADN26868

SEQ ID NO: 202937 - RNA, 1410 nt, Artificial Sequence; identical to SEQ ID NO: 199762
  derived and/or modified sequence opt5 from neuraminidase__InfluenzaA__ADN26869

SEQ ID NO: 202938 - RNA, 1410 nt, Artificial Sequence; identical to SEQ ID NO: 199762
  derived and/or modified sequence opt5 from neuraminidase__InfluenzaA__ADN26870

SEQ ID NO: 202939 - RNA, 1410 nt, Artificial Sequence
  derived and/or modified sequence opt5 from neuraminidase__InfluenzaA__ADN26871
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguacaaccaauccgucauuaccuaugaaaauaacacauggguuaaucagaccuacgugaacaucucuaauacaaacuucgcugccgggcagagcguggucuccgugaaacuugcgggaaauucuagccuguguccuguuuccggcugggcuauuuauagcaaggacaacucuaucagaaucggguccaaaggagauguguuugucauucgggagccguucaucagcugcucuccccucgaaugucgcaccuuuuuccugacacagggcgcccuucugaaugacaagcauuccaacggcaccauuaaagauagaagcccuuaccggacgcucaugucuugccccaucggggaggugccuucccccuauaacagccgcuuugaauccguugccuggucugcuagcgccugucacgacggaauuaauuggcugaccaucggcaucuccgggccugauaacggagcuguggccguccugaaguacaauggcauuaucacagacaccauuaagagcuggagaaacaauauccuccggacacaagagucugagugcgcgugugugaacggguccugcuucaccgugaugacggauggaccgagcgacggccaggccucuuauaaaauuuuucgcaucgaaaagggcaaaaucgucaagagcguugagaugaaugcucccaacuaccauuacgaagaguguuccugcuauccugauucuagcgagauuacaugugugugcagagacaauuggcacggguccaaccggcccugggugagcuucaaucagaaccuggaauaccagaucggauauauuugcucuggcaucuuuggggauaauccucgccccaacgacaaaaccggauccuguggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaucccgagcuuacaggacuggauugcauccgcccuuguuucuggguggaacucauuagaggccggcccaaagagaacacgaucuggaccuccgggagcucuauuuccuuuugcggaguuaauagcgacacagugggcuggucuuggcccgauggggcugagcugccuuucaccaucgacaaguga

SEQ ID NO: 202940 - RNA, 1410 nt, Artificial Sequence
  derived and/or modified sequence opt5 from neuraminidase__InfluenzaA__ADN26872
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcuuagcguggucuccgugaaacuggcgggaaauucuagccucugcccuguuuccggcugggcuauuuacagcaaggacaacucuaucagaaucggguccaaaggagauguguuugucauucgggagccguucaucagcuguucuccccuggaaugccgcaccuuuuuccuuacacagggcgcccugcucaaugacaagcauuccaacggcaccauuaaagauagaagcccuuaucggacgcugaugucuugucccaucggggaggugccuucccccuacaacagccgcuuugaauccguugccuggucugcuagcgccugccacgacggaauuuccuggcugaccaucggcaucagcgggccugauaauggagcuguggccguccucaaguauaacggcauuaucacagacaccauuaagucuuggagaaauaacauccugcggacacaggaguccgagugugcgugcgugaaugggagcuguuucaccgugaugacggauggaccgucugacggccaagccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuugaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaggacaucgugggcauuaacgaauggucuggguacagcggcuccuucguccaacaucccgagcugacaggacucgauuguauccgcccuugcuucuggguggaacugauuagaggccggcccaaagagaauacgaucuggaccagcgggucuuccauuagcuuuuguggaguuaacucugacacagugggcugguccuggcccgauggggcugagcuuccuuucaccaucgacaaguga

SEQ ID NO: 202941 - RNA, 1410 nt, Artificial Sequence; identical to SEQ ID NO: 199762
  derived and/or modified sequence opt5 from neuraminidase__InfluenzaA__ADN26873

SEQ ID NO: 202942 - RNA, 1410 nt, Artificial Sequence; identical to SEQ ID NO: 199762
  derived and/or modified sequence opt5 from neuraminidase__InfluenzaA__ADN26874

SEQ ID NO: 202943 - RNA, 1410 nt, Artificial Sequence; identical to SEQ ID NO: 199762
  derived and/or modified sequence opt5 from neuraminidase__InfluenzaA__ADN26875

SEQ ID NO: 202944 - RNA, 1410 nt, Artificial Sequence; identical to SEQ ID NO: 199762
  derived and/or modified sequence opt5 from neuraminidase__InfluenzaA__ADN26876

SEQ ID NO: 202945 - RNA, 1410 nt, Artificial Sequence; identical to SEQ ID NO: 199762
  derived and/or modified sequence opt5 from neuraminidase__InfluenzaA__ADN26877

SEQ ID NO: 202946 - RNA, 1410 nt, Artificial Sequence; identical to SEQ ID NO: 199762
  derived and/or modified sequence opt5 from neuraminidase__InfluenzaA__ADN26878

SEQ ID NO: 202947 - RNA, 1410 nt, Artificial Sequence; identical to SEQ ID NO: 200899
  derived and/or modified sequence opt5 from neuraminidase__InfluenzaA__ADN26879

SEQ ID NO: 202948 - RNA, 1410 nt, Artificial Sequence; identical to SEQ ID NO: 199762
  derived and/or modified sequence opt5 from neuraminidase__InfluenzaA__ADN26880

SEQ ID NO: 202949 - RNA, 1410 nt, Artificial Sequence; identical to SEQ ID NO: 199762
  derived and/or modified sequence opt5 from neuraminidase__InfluenzaA__ADN26881

SEQ ID NO: 202950 - RNA, 1410 nt, Artificial Sequence; identical to SEQ ID NO: 199762
  derived and/or modified sequence opt5 from neuraminidase__InfluenzaA__ADN26882

SEQ ID NO: 202951 - RNA, 1410 nt, Artificial Sequence; identical to SEQ ID NO: 199762
  derived and/or modified sequence opt5 from neuraminidase__InfluenzaA__ADN26883

SEQ ID NO: 202952 - RNA, 1413 nt, Artificial Sequence
  derived and/or modified sequence opt5 from neuraminidase__InfluenzaA__ADN89064
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagacggggcuuugagaugauuugggaccccaauggguggacgaacaccgacucugauuucuccgugaagcaggacguuguggcgaucacagauuggagcggcuauuccggaucuuuuguccagcacccggaacucaccggccuggacugcauccgcccuuguuucuggguggagcuuguuagagggcugccccgggaaaacacaaccauuuggacgagcggauccucuaucagcuucugcggcgucaauuccgauacagccaacuggagcuggccugacggggcugagcuccccuuuaccauugauaaauga

SEQ ID NO: 202953 - RNA, 1413 nt, Artificial Sequence; identical to SEQ ID NO: 200485
  derived and/or modified sequence opt5 from neuraminidase__InfluenzaA__ADN89075

SEQ ID NO: 202954 - RNA, 1413 nt, Artificial Sequence
  derived and/or modified sequence opt5 from neuraminidase__InfluenzaA__ADN89086
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaagacagcuagcuacaaaaucuucaagauugaaaagggaaaagugaccaaguccaucgagcugaacgccccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuacaguggauggcgcuaacggggugaaaggauucuccuauaaguacggcaauggggucuggaucggacggacgaaaagcaaccgccugagaaagggcuuugagaugauuugggaccccaauggguggaccaacacagacucugauuucuccgugaaacaggacguuguggccaucaccgauuggagcggcuauuccggaucuuuuguccagcacccggaacucacaggccuggacugcauccggccuuguuucuggguggagcuuguucgcgggcugcccagagaaaacaccacgauuuggacaagcggauccucuaucagcuucugcggcgucaauuccgauaccgcgaacuggagcuggccugacggggccgagcuccccuuuaccauugauaaguga

SEQ ID NO: 202955 - RNA, 1413 nt, Artificial Sequence; identical to SEQ ID NO: 200485
  derived and/or modified sequence opt5 from neuraminidase__InfluenzaA__ADN89097

SEQ ID NO: 202956 - RNA, 1413 nt, Artificial Sequence
  derived and/or modified sequence opt5 from neuraminidase__InfluenzaA__ADN89108
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguugugagcaucacagauugguccggcuauucuggcagcuuuguccagcacccggaacucaccggacuggacugcauccggccuuguuucuggguggagcuuguucgcgggcugcccagagaaaacacaaccauuuggacguccggaucuagcaucuccuucugcggcgugaauagcgauacagcgaacuggucuuggccugacggggccgagcuccccuuuaccauugauaaguga

SEQ ID NO: 202957 - RNA, 1413 nt, Artificial Sequence
  derived and/or modified sequence opt5 from neuraminidase__InfluenzaA__ADN89119
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccgugaacggcgccgauggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcacacggccuuguuucuggguggagcuuguucgcgggcugcccagagaaaacaccacgaucuggacaagcggauccucuauuagcuucugcggcgucaauuccgauaccgccaacuggagcuggccugacggggcugagcuccccuuuaccaucgauaaguga

SEQ ID NO: 202958 - RNA, 1413 nt, Artificial Sequence
  derived and/or modified sequence opt5 from neuraminidase__InfluenzaA__ADN89130
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaacuucgaaucuguggccuggagcgcuuccgccugucacgauggcaugggguggcugaccaucggaauuagcggcccugacaauggggcggucgccgugcugaaguauaacggaaucauuacaggcaccaucaagucuuggaaaaagcagauucucagaacgcaggaguccgagugcguuuguaugaauggcagcugcuuuacaaucaugaccgaugggcccucuaacaaagcugccagcuacaagaucuucaaaauugaaaagggaaaggugacaaaauccaucgagcugaaugcuccuaacuuuuauuacgaagaguguucuugcuacccggacaccggcauugucaugugugugugccgggauaauuggcaugggagcaaccgccccuggguguccuucaaucagaaccuugacuaucaaaucggauacauuugcagcggcgucuuuggggauaauccuagacccgaggacggagaaggcucuuguaacccuguuaccguggauggcgccaauggggugaagggauucuccuauaaauacggcaacggggucuggaucggacggacaaagagcaaucgccugagaaaaggcuuugagaugauuugggaccccaacggguggacgaacaccgacucugauuucuccgugaagcaggacguuguggcgaucacagauuggagcggcuauuccggaucuuuuguccagcacccggaacucaccggccuggacugcauccggccuuguuucuggguggagcuuguucgcgggcugcccagagaaaauacaaccauuuggacgagcggauccucuaucagcuucugcggcgugaacggggauacagccaauugguccuggccugacggagcugagcuccccuuuaccauugauaaauga

SEQ ID NO: 202959 - RNA, 1413 nt, Artificial Sequence; identical to SEQ ID NO: 202956
  derived and/or modified sequence opt5 from neuraminidase__InfluenzaA__ADN89141

SEQ ID NO: 202960 - RNA, 1413 nt, Artificial Sequence
  derived and/or modified sequence opt5 from neuraminidase__InfluenzaA__ADN89152
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccaucgauggcgccaacggggugaaaggauucuccuauaaguacggcaaugggguguggauuggacggacaaaaagcaaccgccugagaaagggcuuugagaugaucugggaccccaauggguggacgaacaccgacucugauuucuccgucaaacaggacgugguugcgaucacagauuggagcggcuauuccggaucuuuugugcagcacccggaacucaccggccuggacugcauucggccuuguuucugggucgagcuugugcgcgggcugcccagagaaaacacaaccaucuggacgagcggauccucuauuagcuucugcggcguuaauuccgauacagccaacuggagcuggccugacggggcugagcuccccuuuaccaucgauaaguga

SEQ ID NO: 202961 - RNA, 1413 nt, Artificial Sequence
  derived and/or modified sequence opt5 from neuraminidase__InfluenzaA__ADN89163
augaaccccaaucagagaaucauuaccaucggcagcauuuccaucgccauugggaucaucucucugaugcuccaaauuggaaacaucauuagcaucugggcuucccacucuauucagacaggcagccagaauaacacggggaucugcaaucagcggauuaucaccuacgagaacuccacaugggugaaucauaccuaugucaacaucaauaacacaaauguuguggccggagaagacaagaccucugugacacuggcgggcaacagcucccuuuguagcauuucugggugggcuaucuacaccaaagauaauuccauucgcaucggaagcaagggcgacgucuucgugauuagagagccuuuuaucucuugcucccaccuggaaugucggacguucuuucucacccaaggcgcccugcuuaacgauaaacauagcaaugggacagccaaggaccgcucuccguauagagcucugauguccugcccccucggagaggccccuagccccuacaacuccaaauucgaaucuguugcuuggagcgccuccgcgugucacgauggcaugggguggcugaccaucggaauuagcggcccugacaacggggccguggcuguccugaaguauaauggaaucauuacaggcaccaucaagucuuggaaaaagcagauucuccggacgcaggaguccgagugcguguguaugaacggcagcugcuuuacaaucaugaccgaugggcccucuaauaaagccgcuagcuacaagaucuucaaaauugaaaagggaaagguuacaaaauccaucgagcugaacgccccuaauuuuuauuacgaagaguguucuugcuacccggacaccggcauugugaugugugucugccgcgauaacuggcaugggagcaauagacccuggguguccuucaaccagaaucuugacuaucaaaucggauacauuugcagcggcguguuuggggauaacccucggcccgaggacggagaaggcucuuguaauccugucaccguugauggcgcgaacggggugaagggauucuccuauaaauacggcaaugggguguggaucggacgcacaaagagcaacagacugcggaaaggcuuugagaugauuugggaccccaauggguggacgaacaccgacucugauuucuccgucaagcaggacgugguugccaucacagauuggagcggcuauuccggaucuuuugugcagcacccggaacucaccggccuggacugcauccgcccuuguuucugggucgagcuugugagagggcugccccgggaaaacacaaccauuuggacgagcggauccucuaucagcuucugcggcguuaauuccgauacagcuaacuggagcuggccugacggggccgagcuccccuuuaccauugauaaauga

SEQ ID NO: 202962 - RNA, 1413 nt, Artificial Sequence; identical to SEQ ID NO: 201954
  derived and/or modified sequence opt5 from neuraminidase__InfluenzaA__ADN89174

SEQ ID NO: 202963 - RNA, 1413 nt, Artificial Sequence; identical to SEQ ID NO: 202956
  derived and/or modified sequence opt5 from neuraminidase__InfluenzaA__ADN89185

SEQ ID NO: 202964 - RNA, 1413 nt, Artificial Sequence
  derived and/or modified sequence opt5 from neuraminidase__InfluenzaA__ADN89196
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacagauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuuuauuacgaagaguguagcugcuacccggacaccggcauugucaugugugugugccgggauaauuggcauggguccaaccgccccugggugagcuucaaucagaaccuugacuaucaaaugggauacaucugcucuggcgucuuuggggauaauccuagacccgaggacggagaaggcuccuguaacccuguuaccguggauggcgccaauggggugaaaggauucagcuauaaguacggcaacggggucuggauuggacggacaaaaucuaaucgccugagaaagggcuuugagaugaucugggaccccaacggguggacgaauaccgacuccgauuucagccucaaacaggacgugguugcgauuacagauugguccggcuauucuggaucuuuugugcagcacccggaacugaccggccuugacugcauccggccuuguuucugggucgagcuggugcgcgggcuccccagagaaaacacaaccaucuggacguccggaucuagcauuuccuucugcggcguuaacagcgauacagccaauuggucuuggccugacggggcugagcugcccuuuaccaucgauaaguga

SEQ ID NO: 202965 - RNA, 1413 nt, Artificial Sequence; identical to SEQ ID NO: 202964
  derived and/or modified sequence opt5 from neuraminidase__InfluenzaA__ADN89207

SEQ ID NO: 202966 - RNA, 1413 nt, Artificial Sequence
  derived and/or modified sequence opt5 from neuraminidase__InfluenzaA__ADN89218
augaaccccaaucagaagaucauuaccaucggcagcauuuccaucgccauugggaucaucucucugaugcuccaaauuggaaacaucauuagcaucugggcuucccacucuauucagccuggcagccagaauaacacagggaucugcaaucagagaauuaucacguacgagaacuccaccugggugaaucauacauaugucaacaucaauaacaccaauguuguggccggagaagacaaaacaucugugacccuggcgggcaacagcucccuuuguagcauuucugggugggcuaucuacacaaaggauaauuccauucggaucggaagcaaaggcgacgucuucgugauucgcgagccguuuaucucuugcucccaccuggaauguagaaccuucuuucucacgcaaggcgcccugcuuaacgauaagcauagcaaugggaccguuaaagaccggucucccuaucgcgcccugauguccugcccucucggagaggcucccagcccuuacaacuccaaguucgaaucuguggccuggagcgcuuccgccugucacgauggcaugggguggcugacaaucggaauuagcggccccgacaacggggcggucgccgugcugaaguauaauggaaucauuaccggcacaaucaaaucuuggaagaaacagauucucagaacccaggaguccgagugcguuuguaugaacggcagcugcuuuacgaucaugacagaugggccuucuaauaaggcugccagcuacaaaaucuucaagauugaaaagggaaaagugaccaaguccaucgagcugaacgcuccgaauuuuuauuacgaagaguguucuugcuaccccgacacaggcauugucaugugugugugccgggauaacuggcaugggagcaaucgcccuuggguguccuucaaccagaaucuugacuaucaaaucggauacauuugcagcggcgucuuuggggauaaccccagaccugaggacggagaaggcucuuguaaucccguuaccguggauggcgccaacggggugaaaggauucuccuauaaguacggcaauggggucuggaucggacggaccaaaagcaaccgccugagaaagggcuuugagaugauuugggacccgaauggguggacaaacacggacucugauuucuccgugaaacaggacguuguggcgaucaccgauuggagcggcuauuccggaucuuuuguccagcacccugaacucacaggccuggacugcauccggcccuguuucuggguggagcuuguucgcgggcugccuagagaaaacaccacaauuuggaccagcggauccucuaucagcuucugcggcgugaauggggauacggccaacugguccuggcccgacggagcugagcuccccuuuacaauugauaaguga

SEQ ID NO: 202967 - RNA, 1413 nt, Artificial Sequence
  derived and/or modified sequence opt5 from neuraminidase__InfluenzaA__ADN89229
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgacaaccgauuggagcggcuauuccggaucuuuuguccagcacccggaacucacaggccuggacugcauccggccuuguuucuggguggagcuuguucgcgggcugcccagagaaaacaccacgaucuggacaagcggauccucuauuagcuucugcggcgucaauuccgauaccgccaacuggagcuggccugacggggcugagcuccccuuuaccaucgauaaguga

SEQ ID NO: 202968 - RNA, 1413 nt, Artificial Sequence
  derived and/or modified sequence opt5 from neuraminidase__InfluenzaA__ADN89240
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcauccggccuuguuucuggguggagcuuguucgcgggcugcccagagaaaacacaaccauuuggacgagcggauccucuaucagcuucugcggcgugaauggggauacagccaacugguccuggccugacggagcugagcuccccuuuaccauugauaaguga

SEQ ID NO: 202969 - RNA, 1413 nt, Artificial Sequence; identical to SEQ ID NO: 200485
  derived and/or modified sequence opt5 from neuraminidase__InfluenzaA__ADN89251

SEQ ID NO: 202970 - RNA, 1413 nt, Artificial Sequence; identical to SEQ ID NO: 200485
  derived and/or modified sequence opt5 from neuraminidase__InfluenzaA__ADN89262

SEQ ID NO: 202971 - RNA, 1413 nt, Artificial Sequence; identical to SEQ ID NO: 200485
  derived and/or modified sequence opt5 from neuraminidase__InfluenzaA__ADN89273

SEQ ID NO: 202972 - RNA, 1413 nt, Artificial Sequence; identical to SEQ ID NO: 200485
  derived and/or modified sequence opt5 from neuraminidase__InfluenzaA__ADN89284

SEQ ID NO: 202973 - RNA, 1413 nt, Artificial Sequence; identical to SEQ ID NO: 200485
  derived and/or modified sequence opt5 from neuraminidase__InfluenzaA__ADN89295

SEQ ID NO: 202974 - RNA, 1413 nt, Artificial Sequence; identical to SEQ ID NO: 200485
  derived and/or modified sequence opt5 from neuraminidase__InfluenzaA__ADN89306

SEQ ID NO: 202975 - RNA, 1413 nt, Artificial Sequence
  derived and/or modified sequence opt5 from neuraminidase__InfluenzaA__ADN89317
augaaccccaaucagagaaucauuaccaucggcagcauuuccaucgccauugggaucaucucucugaugcuccaaauuggaaacaucauuagcaucugggcuucccacucuauucagacaggcagccagaauaacacggggaucugcaaucagcggauuaucaccuacgagaacuccacaugggugaaucauaccuaugucaacaucaauucuacaaacguuguggccggagaagacaagaccagcgugacacuggcgggcaauuccagccuuuguucuauuuccgggugggcuaucuacaccaaagauaacagcauucgcaucggaucuaagggcgacgucuucgugauuagagagccuuuuaucuccugcagccaccuggaaugucggacguucuuucucacccaaggcgcccugcuuaaugauaaacauucuaacgggacaguuaaggaccgcuccccguauagagcccugaugagcugcccccucggagaggcuccuucccccuacaauucuaaauucgaaagcguggccugguccgcuagcgccugucacgauggcaugggguggcugaccaucggaauuucuggcccugacaacggggcggucgccgugcugaaguauaacggaaucauuacaggcaccaucaaguccuggaaaaagcagauucuccggacgcaggagagcgagugcguuuguaugaauggcucuugcuuuacaaucaugaccgaugggcccagcaacaaagcugccuccuacaagaucuucaaaauugaaaagggaaaggugacaaaaucuaucgagcugaaugcuccuaacuuuuauuacgaagaguguagcugcuacccggacaccggcauugucaugugugugugccgcgauaauuggcauggguccaacagacccugggugagcuucaaucagaaccuugacuaucaaaucggauacauuugcucuggcgucuuuggggauaauccucggcccgaggacggagaaggcuccuguaacccuguuaccguggauggcgccaauggggugaagggauucagcuauaaauacggcaacggggucuggaucggacgcacaaagucuaauagacugcggaaaggcuuugagaugauuugggaccccaacggguggacgaauaccgacuccgauuucagcgugaagcaggacguuguggcgaucacagauugguccggcuauucuggcagcuuuguccagcacccggaacucaccggacuggacugcauccgcccuuguuucuggguggagcuuguuagagggcugccccgggaaaacacaaccauuuggacguccggaucuagcaucuccuucugcggcgugaacggggauacagccaauuggagcuggccugacggagcugagcuccccuuuaccauugauaaauga

SEQ ID NO: 202976 - RNA, 1413 nt, Artificial Sequence
  derived and/or modified sequence opt5 from neuraminidase__InfluenzaA__ADN89328
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacagauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuuuauuacgaagaguguagcugcuacccggacaccggcauugucaugugugugugccgggauaauuggcauggguccaaccgccccugggugagcuucaaucagaaccuugacuaucaaaucggauacauuugcucuggcgucuuuggggauaauccuagacccgaggacggagaaggcuccuguaacccuguuaccguggauggcgccaauggggugaaaggauucagcuauaaguacggcaacggggucuggaucggacggacaaaaucuaaucgccugagaaagggcuuugagaugauuugggaccccaacggguggacgaauaccgacuccgauuucagcgugaaacaggacguuguggcgaucacagauugguccggcuauucuggaucuuuuguccagcacccggaacucaccggccuggacugcauccggccuuguuucuggguggagcuuguucgcgggcugcccagagaaaacacaaccauuugggccuccggaucuagcaucuccuucugcggcgugaacagcgauacggcuaauuggucuuggccugacggggccgagcuccccuuuacaauugauaaguga

SEQ ID NO: 202977 - RNA, 1413 nt, Artificial Sequence; identical to SEQ ID NO: 202961
  derived and/or modified sequence opt5 from neuraminidase__InfluenzaA__ADN89339

SEQ ID NO: 202978 - RNA, 1413 nt, Artificial Sequence; identical to SEQ ID NO: 202967
  derived and/or modified sequence opt5 from neuraminidase__InfluenzaA__ADN89350

SEQ ID NO: 202979 - RNA, 1413 nt, Artificial Sequence
  derived and/or modified sequence opt5 from neuraminidase__InfluenzaA__ADN89361
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucauuauccgcgagccuuuuaucuccugcagccaccuggaauguagaacguucuuucucacccaaggcgcccugcuuaaugauaagcauucuaacgggacagugaaagaccgguccccguaucgcgcccugaugagcugcccccucggagaggcuccuucccccuacaauucuaaguucgaaagcguugccugguccgcuagcgccugucacgauggcaugggguggcugaccauuggaaucucuggcccugacaacggggcgguggccguccugaaguauaacggaauuaucacaggcaccauuaaauccuggaagaaacagauccucagaacgcaggagagcgagugcguguguaugaauggcucuugcuuuacaaucaugaccgaugggcccagcaacaaggcugccuccuacaaaauuuucaagaucgaaaagggaaaaguuacaaagucuauugagcugaaugcuccuaacuuuuauuacgaagaguguagcugcuacccggacaccggcaucgugaugugugucugccgggauaauuggcauggguccaaccgccccugggugagcuucaaucagaaccuugacuaucaaauuggauacaucugcucuggcguguuuggggauaauccuagacccgaggacggagaaggcuccuguaacccugucaccguugauggcgccaauggggugaaaggauucagcuauaaguacggcaacgggguguggauuggacggacaaaaucuaaucgccugagaaagggcuuugagaugaucugggaccccaacggguggacgaauaccgacuccgauuucagcgucaaacaggacgugguugcgaucacagauugguccggcuauucuggaucuuuugugcagcacccggaacucaccggccuggacugcauucggccuuguuucugggucgagcuugugcgcgggcugcccagagaaaacacaaccaucuggacguccggaucuagcauuuccuucugcggcguuaacagcgauacagccaauuggucuuggccugacggggcugagcuccccuuuaccaucgauaaguga

SEQ ID NO: 202980 - RNA, 1413 nt, Artificial Sequence
  derived and/or modified sequence opt5 from neuraminidase__InfluenzaA__ADN89372
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauauuguugccggagaagacaaaaccucugugacacuggcgggcaacagcucccuuuguagcaucucugggugggcuauuuacaccaaggauaauuccauccggauuggaagcaaaggcgacguguucgucauccgcgagccuuuuaucucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucuguugccuggagcgcuuccgccugucacgauggcaugggguggcugaccauuggaaucagcggcccugacaacggggcgguggccguccugaaguauaauggaauuaucacaggcaccauuaaaucuuggaagaaacagauccucagaacgcaggaguccgagugcguguguaugaacggcagcugcuuuacaaucaugaccgaugggcccucuaauaaggcugccagcuacaaaauuuucaagaucgaaaagggaaaaguuacaaaguccauugagcugaacgcuccuaauuuuuauuacgaagaguguucuugcuacccggacaccggcaucgugaugugugucugccgggauaacuggcaugggagcaaucgccccuggguguccuucaaccagaaucuugacuaucaaauuggauacaucugcagcggcguguuuggggauaacccuagacccgaggacggagaaggcucuuguaauccugucaccguuaacggcgccgauggggugaaaggauucuccuauaaguacggcaaugggguguggauuggacggacaaaaagcaaccgccugagaaagggcuuugagaugaucugggaccccaauggguggacgaacaccgacucugauuucuccgucaaacaggacgugguugcgaucacagauuggagcggcuauuccggaucuuuugugcagcacccggaacucaccggccuggacugcauucggccuuguuucugggucgagcuugugcgcgggcugcccagagaaaacacaaccaucuggacgagcggauccucuauuagcuucugcggcguuaauuccgauacagccaacuggagcuggccugacggggcugagcuccccuuuaccaucgauaaguga

SEQ ID NO: 202981 - RNA, 1413 nt, Artificial Sequence; identical to SEQ ID NO: 202956
  derived and/or modified sequence opt5 from neuraminidase__InfluenzaA__ADN89383

SEQ ID NO: 202982 - RNA, 1413 nt, Artificial Sequence
  derived and/or modified sequence opt5 from neuraminidase__InfluenzaA__ADN89405
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuaccuccgggugggcuauuuacacgaaggauaacagcauccggauuggaucuaaaggcgacgucuucgugauccgcgagccuuuuauuuccugcagccaccuggaauguagaaccuucuuucucacacaaggcgcccugcuuaaugauaagcauucuaacgggaccguuaaagaccgguccccguaucgcgcccugaugagcugcccccucggagaggcuccuucccccuacaauucuaaguucgaaagcguggccugguccgcuagcgccugucacgauggcaugggguggcugacaaucggaaucucuggcccugacaacggggcggucgccgugcugaaguauaacggaauuaucaccggcacgauuaaauccuggaagaaacagauccucagaacacaggagagcgagugcguuuguaugaauggcucuugcuuuaccauuaugacagaugggcccagcaacaaggcugccuccuacaaaaucuucaagaucgaaaagggaaaagugaccaagucuauugagcugaaugcuccuaacuuuuauuacgaagaguguagcugcuacccggacaccggcaucgucaugugugugugccgggauaauuggcauggguccaaccgccccugggugagcuucaaucagaaccuugacuaucaaauuggauacaucugcucuggcgucuuuggggauaauccuagacccgaggacggagaaggcuccuguaacccuguuacaguggauggcgccaauggggugaaaggauucagcuauaaguacggcaacggggucuggauuggacggacgaaaucuaaucgccugagaaagggcuuugagaugaucugggaccccaacggguggaccaauacagacuccgauuucagcgugaaacaggacguuguggcgauuaccgauugguccggcuauucuggaucuuuuguccagcacccggaacucacaggccuggacugcauccggccuuguuucuggguggagcuuguucgcgggcugcccagagaaaacaccacgaucuggacauccggaucuagcauuuccuucugcggcgugaacagcgauaccgccaauuggucuuggccugacggggcugagcuccccuuuaccaucgauaaguga

SEQ ID NO: 202983 - RNA, 1413 nt, Artificial Sequence
  derived and/or modified sequence opt5 from neuraminidase__InfluenzaA__ADN89416
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcguccugggggauaacccuagacccgaggacggagaaggcucuuguaauccuguuaccguggauggcgccaacggggugaaaggauuuuccuauaaguacggcaauggggucuggaucggacggacaaaaagcaaccgccucagaaagggcuucgagaugauuugggaccccaauggguggacgaacaccgacucugauuuuuccgugaaacaggacguuguggcgaucacagauuggagcggcuauuccggaucuuucguccagcacccggaacugaccggccuugacugcauccggccuuguuuuuggguggagcugguucgcgggcuccccagagaaaacacaaccauuuggacgagcggauccucuaucagcuucugcggcgugaauggggauacagccaacugguccuggccugacggagcugagcugcccuucaccauugauaaguga

SEQ ID NO: 202984 - RNA, 1413 nt, Artificial Sequence
  derived and/or modified sequence opt5 from neuraminidase__InfluenzaA__ADN89427
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacagauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuuuauuacgaagaguguagcugcuacccggacaccggcauugucaugugugugugccgggauaauuggcauggguccaaccgccccugggugagcuucaaucagaaccuugacuaucaaaucggauacauuugcucuggcgucuuuggggauaauccuagacccgaggacggagaaggcuccuguaacccuguuaccguggauggcgccaauggggugaaaggauucagcuauaaguacggcaacggggucuggaucggacggacaaaaucuaaucgccugagaaagggcuuugagaugauuugggaccccaacggguggacgaauaccgacuccgauuucagcgugaaacaggacguuguggcgaucacagauugguccggcuauucuggaucuuuuguccagcacccggaacucaccggccuggacugcauccggccuuguuucuggguggagcuuguucgcgggcugcccagagaaaacacaaccauuuggacguccggaucuagcaucuccuucugcggcguggauagcgacgccgcugauuggucuuggccugacggggccgagcuccccuuuacaauugauaaguga

SEQ ID NO: 202985 - RNA, 1413 nt, Artificial Sequence; identical to SEQ ID NO: 200485
  derived and/or modified sequence opt5 from neuraminidase__InfluenzaA__ADN89438

SEQ ID NO: 202986 - RNA, 1413 nt, Artificial Sequence
  derived and/or modified sequence opt5 from neuraminidase__InfluenzaA__ADN89449
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaccuucugugacccuggcgggcaacagcucccuuuguagcauuucugggugggcuaucuacacaaaggauaauuccauucggaucggaagcaaaggcgacgucuucgugauucgcgagccguuuaucucuugcucccaccuggaauguagaaccuucuuucucacgcaaggcgcccugcuuaacgauaagcauagcaaugggaccguuaaagaccggucucccuaucgcgcccugauguccugcccucucggagaggcucccagcccuuacaacuccaaguucgaaucuguggccuggagcgcuuccgccugucacgauggcaugggguggcugacaaucggaauuagcggccccgacaacggggcggucgccgugcugaaguauaauggaaucauuaccggcacaaucaaaucuuggaagaaacagauucucagaacccaggaguccgagugcguuuguaugaacggcagcugcuuuacgaucaugacagaugggccuucuaauaaggcugccagcuacaaaaucuucaagauugaaaagggaaaagugaccaaguccaucgagcugaacgcuccgaauuuuuauuacgaagaguguucuugcuaccccgacacaggcauugucaugugugugugccgggauaacuggcaugggagcaaucgcccuuggguguccuucaaccagaaucuugacuaucaaaucggauacauuugcagcggcgucuuuggggauaaccccagaccugaggacggagaaggcucuuguaaucccguuaccguggauggcgccaacggggugaaaggauucuccuauaaguacggcaauggggucuggaucggacggaccaaaagcaaccgccugagaaagggcuuugagaugauuugggacccgaauggguggacaaacacggacucugauuucuccgugaaacaggacguuguggcgaucaccgauuggagcggcuauuccggaucuuuuguccagcacccugaacucacaggccuggacugcauccggcccuguuucuggguggagcuuguucgcgggcugccuagagaaaacaccacaauuuggaccagcggauccucuaucagcuucugcggcgucaauuccgauacggccaacuggagcuggcccgacggggcugagcuccccuuuacaauugauaaguga

SEQ ID NO: 202987 - RNA, 1413 nt, Artificial Sequence; identical to SEQ ID NO: 201954
  derived and/or modified sequence opt5 from neuraminidase__InfluenzaA__ADN89460

SEQ ID NO: 202988 - RNA, 1413 nt, Artificial Sequence; identical to SEQ ID NO: 200485
  derived and/or modified sequence opt5 from neuraminidase__InfluenzaA__ADN89482

SEQ ID NO: 202989 - RNA, 1413 nt, Artificial Sequence
  derived and/or modified sequence opt5 from neuraminidase__InfluenzaA__ADN89493
augaaccccaaucagaagaucauuaccaucggcagcauuuccaucgccauugggaucaucucucugaugcuccaaauuggaaacaucauuagcaucugggcuucccacucuauucagacagagagccagaauaacacgggcaucugcaaucagagaauuaucaccuacgaaaacuccacaugggugaaucauaccuaugugaacaucaauaacacaaauguuguggccggggaggacaaaaccucugugacacuggcgggaaacagcucccuuuguagcauuucuggcugggcuaucuacaccaaggauaauuccauucggaucgggagcaaaggagacgucuucgugauucgcgaaccuuuuaucucuugcucccaccuggaguguagaacguucuuucucacccaaggcgcccugcuuaacgauaagcauagcaauggcacaguuaaagaccggucuccguaucgcgcccugauguccugcccccucggggaagcuccuagccccuacaacuccaaguucgagucuguggccuggagcgcuuccgccugucacgauggaaugggcuggcugaccaucgggauuagcggaccugacaacggcgcggucgccgugcugaaguauaaugggaucauuacaggaaccaucaaaucuuggaagaaacagauucucagaacgcaggaguccgaaugcguuuguaugaacggcagcugcuuuacaaucaugaccgauggccccucuaauaaggcugccagcuacaaaaucuucaagauugagaaggggaaagugacaaaguccaucgaacugaacgcuccuaauuuuuauuacgaggaguguucuugcuacccggacaccggaauugucaugugugugugccgggauaacuggcauggcagcaaucgccccuggguguccuucaaccagaaucuugacuaucaaaugggguacaucugcagcggagucuuuggcgauaacccuagacccgaagacggggagggaucuuguaauccuguuaccguggauggcgccaacggcgugaaaggguucuccuauaaguacggaaauggcgucuggauugggcggacaaaaagcaaccgccugagaaagggauuugaaaugaucugggaccccaauggcuggacgaacaccgacucugauuucuccgugaaacaggacguuguggcgauuacagauuggagcggguauuccggcucuuuuguccagcacccggagcucaccggacuggacugcauccggccuuguuucuggguggaacuuguucgcggccugcccagagagaacacaaccaucuggacgagcggguccucuauuagcuucugcggagucaauuccgauacagccaacuggagcuggccugacggcgcugagcuccccuuuaccaucgauaaguga

SEQ ID NO: 202990 - RNA, 1413 nt, Artificial Sequence; identical to SEQ ID NO: 200485
  derived and/or modified sequence opt5 from neuraminidase__InfluenzaA__ADN89504

SEQ ID NO: 202991 - RNA, 1413 nt, Artificial Sequence
  derived and/or modified sequence opt5 from neuraminidase__InfluenzaA__ADN89515
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucacagugaaacaggacguuguggcgaucaccgauugguccggcuauagcggauccuuuguccagcacccggaacucacaggccuggacugcauccggccuuguuucuggguggagcuuguucgcgggcugcccagagaaaacaccacgauuuggacaucuggaagcuccaucucuuucugcggcgugaauagcgauaccgccaacugguccuggccugacggggcugagcuccccuuuaccauugauaaguga

SEQ ID NO: 202992 - RNA, 1413 nt, Artificial Sequence; identical to SEQ ID NO: 200485
  derived and/or modified sequence opt5 from neuraminidase__InfluenzaA__ADN89526

SEQ ID NO: 202993 - RNA, 1413 nt, Artificial Sequence; identical to SEQ ID NO: 202956
  derived and/or modified sequence opt5 from neuraminidase__InfluenzaA__ADN89537

SEQ ID NO: 202994 - RNA, 1413 nt, Artificial Sequence; identical to SEQ ID NO: 200485
  derived and/or modified sequence opt5 from neuraminidase__InfluenzaA__ADN89548

SEQ ID NO: 202995 - RNA, 1413 nt, Artificial Sequence; identical to SEQ ID NO: 200485
  derived and/or modified sequence opt5 from neuraminidase__InfluenzaA__ADN89570

SEQ ID NO: 202996 - RNA, 1413 nt, Artificial Sequence
  derived and/or modified sequence opt5 from neuraminidase__InfluenzaA__ADN89581
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaagacagcuagcuacaaaaucuucaagauugaaaagggaaaagugaccaaguccaucgagcugaacgccccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuacaguggauggcgcuaacggggugaaaggauucuccuauaaguacggcaauggggucuggaucggacggacgaaaagcaaccgccugagaaagggcuuugagaugauuugggaccccaauggguggaccaacacagacucugauuucuccgugaaacaggacguuguggccaucaccgauuggagcggcuauuccggaucuuuuguccagcacccggaacucacaggccuggacugcauccggccuuguuucuggguggagcuuguucgcgggcugcccagagaaaacaccacgauuuggacaagcggauccucuaucagcuucugcggcgugaauggggauaccgcgaacugguccuggccugacggagccgagcuccccuuuaccauugauaaguga

SEQ ID NO: 202997 - RNA, 1413 nt, Artificial Sequence; identical to SEQ ID NO: 201954
  derived and/or modified sequence opt5 from neuraminidase__InfluenzaA__ADN89592

SEQ ID NO: 202998 - RNA, 1413 nt, Artificial Sequence; identical to SEQ ID NO: 201954
  derived and/or modified sequence opt5 from neuraminidase__InfluenzaA__ADN89603

SEQ ID NO: 202999 - RNA, 1413 nt, Artificial Sequence; identical to SEQ ID NO: 202964
  derived and/or modified sequence opt5 from neuraminidase__InfluenzaA__ADN89614

SEQ ID NO: 203000 - RNA, 1413 nt, Artificial Sequence; identical to SEQ ID NO: 202983
  derived and/or modified sequence opt5 from neuraminidase__InfluenzaA__ADN89625

SEQ ID NO: 203001 - RNA, 1413 nt, Artificial Sequence; identical to SEQ ID NO: 200485
  derived and/or modified sequence opt5 from neuraminidase__InfluenzaA__ADN89636

SEQ ID NO: 203002 - RNA, 1413 nt, Artificial Sequence; identical to SEQ ID NO: 200485
  derived and/or modified sequence opt5 from neuraminidase__InfluenzaA__ADN89647

SEQ ID NO: 203003 - RNA, 1413 nt, Artificial Sequence; identical to SEQ ID NO: 200485
  derived and/or modified sequence opt5 from neuraminidase__InfluenzaA__ADN89658

SEQ ID NO: 203004 - RNA, 1413 nt, Artificial Sequence; identical to SEQ ID NO: 201954
  derived and/or modified sequence opt5 from neuraminidase__InfluenzaA__ADN89669

SEQ ID NO: 203005 - RNA, 1413 nt, Artificial Sequence; identical to SEQ ID NO: 200485
  derived and/or modified sequence opt5 from neuraminidase__InfluenzaA__ADN89680

SEQ ID NO: 203006 - RNA, 1413 nt, Artificial Sequence; identical to SEQ ID NO: 200485
  derived and/or modified sequence opt5 from neuraminidase__InfluenzaA__ADN89691

SEQ ID NO: 203007 - RNA, 1413 nt, Artificial Sequence; identical to SEQ ID NO: 202983
  derived and/or modified sequence opt5 from neuraminidase__InfluenzaA__ADN89702

SEQ ID NO: 203008 - RNA, 1413 nt, Artificial Sequence; identical to SEQ ID NO: 200485
  derived and/or modified sequence opt5 from neuraminidase__InfluenzaA__ADN89713

SEQ ID NO: 203009 - RNA, 1413 nt, Artificial Sequence; identical to SEQ ID NO: 200485
  derived and/or modified sequence opt5 from neuraminidase__InfluenzaA__ADN89724

SEQ ID NO: 203010 - RNA, 1413 nt, Artificial Sequence; identical to SEQ ID NO: 200485
  derived and/or modified sequence opt5 from neuraminidase__InfluenzaA__ADN89735

SEQ ID NO: 203011 - RNA, 1413 nt, Artificial Sequence; identical to SEQ ID NO: 200485
  derived and/or modified sequence opt5 from neuraminidase__InfluenzaA__ADN89746

SEQ ID NO: 203012 - RNA, 1413 nt, Artificial Sequence; identical to SEQ ID NO: 200485
  derived and/or modified sequence opt5 from neuraminidase__InfluenzaA__ADN89757

SEQ ID NO: 203013 - RNA, 1413 nt, Artificial Sequence; identical to SEQ ID NO: 200485
  derived and/or modified sequence opt5 from neuraminidase__InfluenzaA__ADN89768

SEQ ID NO: 203014 - RNA, 1413 nt, Artificial Sequence; identical to SEQ ID NO: 202960
  derived and/or modified sequence opt5 from neuraminidase__InfluenzaA__ADN89779

SEQ ID NO: 203015 - RNA, 1413 nt, Artificial Sequence; identical to SEQ ID NO: 200485
  derived and/or modified sequence opt5 from neuraminidase__InfluenzaA__ADN89790

SEQ ID NO: 203016 - RNA, 1413 nt, Artificial Sequence
  derived and/or modified sequence opt5 from neuraminidase__InfluenzaA__ADN89801
augaaccccaaucagaagaucauuaccaucggcagcauuuccaucgccauugggacaaucucucugaugcuccaaaucggaaacauuaucagcauuugggcuucccacucuauccagacgggcagccagaauaacaccgggauuugcaaucagagaaucauuacauacaaaaacuccaccugggugaaucauacauaugucaacaucaauaacaccaauguuguggccggagaggacaagacaucugugacccuggcgggcaacagcucccuuuguagcaucucugggugggcuauuuacacgaaagauaauuccauccggauuggaagcaagggcgacgucuucgugauccgcgaaccuuuuauuucuugcucccaccuggaguguagaaccuucuuucucacacaaggcgcccugcuuaacgauaaacauagcaaugggaccguuaaggaccggucuccguaucgcgcccugauguccugcccccucggagaagcuccuagccccuacaacuccaaguucgagucuguggccuggagcgcuuccgccugucacgauggcaugggguggcugacaaucggaaucagcggcccugacaacggggcggucgccgugcugaaauauaauggaauuaucaccggcacgauuaagucuuggaaaaagcagauccucagaacacaggaauccgagugcguuuguaugaacggcagcugcuuuaccauuaugacagaugggcccucuaauaaagcugccagcuacaagaucuucaagaucgagaaaggaaaggugaccaaauccauugaacugaacgcuccuaauuuuuauuacgaggaauguucuugcuacccggacaccggcaucgucaugugugugugccgggauaacuggcaugggagcaaucgccccuggguguccuucaaccagaaucuugacuaucaaauuggauacaucugcagcggcgucuuuggggauaacccuagacccgaggacggagagggcucuuguaauccuguuacaguggauggcgccaacggggugaagggauucuccuauaaauacggcaauggggucuggauuggacggacgaaguccaaccgccugagaaaaggcuuugaaaugaucugggaccccaauggguggaccaacacagacucugauuucuccgugaagcaggacguuguggcgauuaccgauuggagcggcuauuccggaucuuuuguccagcacccggagcucacaggccuggacugcauccggccuuguuucuggguggaacuuguucgcgggcugcccagagagaacaccacgaucuggacaagcggauccucuauuagcuucugcggcgugaauagcgauaccgccaacuggagcuggccugacggggcugaacuccccuuuaccaucgauaaguga

SEQ ID NO: 203017 - RNA, 1413 nt, Artificial Sequence
  derived and/or modified sequence opt5 from neuraminidase__InfluenzaA__ADN89823
augaaccccaaucagaagaucauuaccaucggcagcauuuccaucgccauugggaucaucucucugaugcuccaaauuggaagcaucauuuccaucugggcuucucacagcauucauacaggcucccagaacaauacggggaucugcaaccagagaauuaucaccuacgagaauagcacaugggugaaccacaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaucuggaauguagaacguucuuucucacccagggcgcccugcuuaaugauaagcacucuaacgggacaguuaaagaccgguccccguaucgcgcccugaugagcugcccccucggagaggcuccuucccccuacaauucuaaguucgaaagcguggccugguccgcuagcgccugucaugauggcaugggguggcugaccaucggaauuucuggcccugacaacggggcggucgccgugcugaaguauaacggaaucauuacaggcaccaucaaauccuggaagaaacaaauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuuuauuacgaagaguguagcugcuacccggacaccggcauugucaugugugugugccgggauaauuggcacggguccaaccgccccugggugagcuucaaucagaaccuugacuaucagaucggauacauuugcucuggcgucuuuggggauaauccuagacccgaggacggagaaggcuccuguaacccuguuaccguggauggcgccaauggggugaaaggauucagcuauaaguacggcaacggggucuggaucggacggacaaaaucuaaucgccugagaaagggcuuugagaugauuugggaccccaacggguggacgaauaccgacuccgauuucagcgugaaacaagacguuguggcgaucacagauugguccggcuauucuggaucuuuuguccagcacccggaacucaccggccuggacugcauccggccuuguuucuggguggagcuuguucgcgggcugcccagagaaaacacaaccauuuggacguccggaucuagcaucuccuucugcggcgugaacagcgauacagccaauuggucuuggccugacggggcugagcuccccuuuaccauugauaaguga

SEQ ID NO: 203018 - RNA, 1413 nt, Artificial Sequence; identical to SEQ ID NO: 201954
  derived and/or modified sequence opt5 from neuraminidase__InfluenzaA__ADN89834

SEQ ID NO: 203019 - RNA, 1413 nt, Artificial Sequence; identical to SEQ ID NO: 202956
  derived and/or modified sequence opt5 from neuraminidase__InfluenzaA__ADN89845

SEQ ID NO: 203020 - RNA, 1413 nt, Artificial Sequence; identical to SEQ ID NO: 200485
  derived and/or modified sequence opt5 from neuraminidase__InfluenzaA__ADN89856

SEQ ID NO: 203021 - RNA, 1410 nt, Artificial Sequence; identical to SEQ ID NO: 202434
  derived and/or modified sequence opt5 from neuraminidase__InfluenzaA__ADN89867

SEQ ID NO: 203022 - RNA, 1410 nt, Artificial Sequence; identical to SEQ ID NO: 202434
  derived and/or modified sequence opt5 from neuraminidase__InfluenzaA__ADN89878

SEQ ID NO: 203023 - RNA, 1410 nt, Artificial Sequence; identical to SEQ ID NO: 202434
  derived and/or modified sequence opt5 from neuraminidase__InfluenzaA__ADN89889

SEQ ID NO: 203024 - RNA, 1410 nt, Artificial Sequence; identical to SEQ ID NO: 202434
  derived and/or modified sequence opt5 from neuraminidase__InfluenzaA__ADN89900

SEQ ID NO: 203025 - RNA, 1410 nt, Artificial Sequence; identical to SEQ ID NO: 202434
  derived and/or modified sequence opt5 from neuraminidase__InfluenzaA__ADN89911

SEQ ID NO: 203026 - RNA, 1410 nt, Artificial Sequence
  derived and/or modified sequence opt5 from neuraminidase__InfluenzaA__ADN89922
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccagcagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucaaugaaacaagcagacucggcuaugagaccuuuaaagugaucgagggguggucuaacccuaaguccaaacugcagauuaaucggcaggucaucguggaccgcggaaacagaagcggcuacucuggcauuuucuccgucgaagggaagucuuguaucaaucggugcuuuuauguggagcugauuagaggacgcaaggaagagaccgaaguucucuggacauccaacucuaucguggucuucuguggcaccagcgggacauacggaacgggcuccuggcccgauggggcugaccugaauauuaugccuaucuga

SEQ ID NO: 203027 - RNA, 1410 nt, Artificial Sequence; identical to SEQ ID NO: 202434
  derived and/or modified sequence opt5 from neuraminidase__InfluenzaA__ADN89933

SEQ ID NO: 203028 - RNA, 1410 nt, Artificial Sequence; identical to SEQ ID NO: 202434
  derived and/or modified sequence opt5 from neuraminidase__InfluenzaA__ADN89955

SEQ ID NO: 203029 - RNA, 1410 nt, Artificial Sequence; identical to SEQ ID NO: 202434
  derived and/or modified sequence opt5 from neuraminidase__InfluenzaA__ADN89966

SEQ ID NO: 203030 - RNA, 1410 nt, Artificial Sequence; identical to SEQ ID NO: 202434
  derived and/or modified sequence opt5 from neuraminidase__InfluenzaA__ADN89977

SEQ ID NO: 203031 - RNA, 1410 nt, Artificial Sequence; identical to SEQ ID NO: 202434
  derived and/or modified sequence opt5 from neuraminidase__InfluenzaA__ADN89988

SEQ ID NO: 203032 - RNA, 1410 nt, Artificial Sequence; identical to SEQ ID NO: 202434
  derived and/or modified sequence opt5 from neuraminidase__InfluenzaA__ADN89999

SEQ ID NO: 203033 - RNA, 1410 nt, Artificial Sequence; identical to SEQ ID NO: 202434
  derived and/or modified sequence opt5 from neuraminidase__InfluenzaA__ADN90010

SEQ ID NO: 203034 - RNA, 1410 nt, Artificial Sequence; identical to SEQ ID NO: 202434
  derived and/or modified sequence opt5 from neuraminidase__InfluenzaA__ADN90021

SEQ ID NO: 203035 - RNA, 1410 nt, Artificial Sequence; identical to SEQ ID NO: 202434
  derived and/or modified sequence opt5 from neuraminidase__InfluenzaA__ADN90032

SEQ ID NO: 203036 - RNA, 1410 nt, Artificial Sequence; identical to SEQ ID NO: 202434
  derived and/or modified sequence opt5 from neuraminidase__InfluenzaA__ADN90043

SEQ ID NO: 203037 - RNA, 1410 nt, Artificial Sequence; identical to SEQ ID NO: 202434
  derived and/or modified sequence opt5 from neuraminidase__InfluenzaA__ADN90054

SEQ ID NO: 203038 - RNA, 1410 nt, Artificial Sequence; identical to SEQ ID NO: 202434
  derived and/or modified sequence opt5 from neuraminidase__InfluenzaA__ADN90065

SEQ ID NO: 203039 - RNA, 1410 nt, Artificial Sequence; identical to SEQ ID NO: 202434
  derived and/or modified sequence opt5 from neuraminidase__InfluenzaA__ADN90076

SEQ ID NO: 203040 - RNA, 1410 nt, Artificial Sequence; identical to SEQ ID NO: 202434
  derived and/or modified sequence opt5 from neuraminidase__InfluenzaA__ADN90087

SEQ ID NO: 203041 - RNA, 1410 nt, Artificial Sequence; identical to SEQ ID NO: 202434
  derived and/or modified sequence opt5 from neuraminidase__InfluenzaA__ADN90098

SEQ ID NO: 203042 - RNA, 1410 nt, Artificial Sequence; identical to SEQ ID NO: 202434
  derived and/or modified sequence opt5 from neuraminidase__InfluenzaA__ADN90109

SEQ ID NO: 203043 - RNA, 1410 nt, Artificial Sequence; identical to SEQ ID NO: 202434
  derived and/or modified sequence opt5 from neuraminidase__InfluenzaA__ADN90120

SEQ ID NO: 203044 - RNA, 1410 nt, Artificial Sequence; identical to SEQ ID NO: 202434
  derived and/or modified sequence opt5 from neuraminidase__InfluenzaA__ADN90131

SEQ ID NO: 203045 - RNA, 1410 nt, Artificial Sequence; identical to SEQ ID NO: 202434
  derived and/or modified sequence opt5 from neuraminidase__InfluenzaA__ADN90142

SEQ ID NO: 203046 - RNA, 1410 nt, Artificial Sequence; identical to SEQ ID NO: 202434
  derived and/or modified sequence opt5 from neuraminidase__InfluenzaA__ADN90153

SEQ ID NO: 203047 - RNA, 1410 nt, Artificial Sequence; identical to SEQ ID NO: 202434
  derived and/or modified sequence opt5 from neuraminidase__InfluenzaA__ADN90164

SEQ ID NO: 203048 - RNA, 1410 nt, Artificial Sequence; identical to SEQ ID NO: 202434
  derived and/or modified sequence opt5 from neuraminidase__InfluenzaA__ADN90186

SEQ ID NO: 203049 - RNA, 1410 nt, Artificial Sequence; identical to SEQ ID NO: 202434
  derived and/or modified sequence opt5 from neuraminidase__InfluenzaA__ADN90197

SEQ ID NO: 203050 - RNA, 1410 nt, Artificial Sequence
  derived and/or modified sequence opt5 from neuraminidase__InfluenzaA__ADN90208
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucaaugaaacaagcagacucggcuaugagaccuuuaaagugaucgagggguggucuaacccuaaguccaaacugcagauuaaucggcaggucaucguggaccgcagcaacagaucuggauacuccggcauuuucagcgucgaaggcaaguccuguaucaaucggugcuuuuauguggagcugauuagagggcgcaaggaagagaccgaaguucucuggacaucuaacagcaucguggucuucuguggaaccuccggcacauacgggacgggaucuuggcccgauggcgcugaccugaaucuuaugccuauuuga

SEQ ID NO: 203051 - RNA, 1410 nt, Artificial Sequence; identical to SEQ ID NO: 202434
  derived and/or modified sequence opt5 from neuraminidase__InfluenzaA__ADN90219

SEQ ID NO: 203052 - RNA, 1410 nt, Artificial Sequence
  derived and/or modified sequence opt5 from neuraminidase__InfluenzaA__ADN92469
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcgagaaggccgauacaaaaauccucuuuaucgaagagggcaagauuguucauaccuccacacugucugggagcgcgcaacacguggaagagugcuccugcuauccuagauaccccggagugcggugugucugccgcgacaacuggaagggcagcaauagaccuaucguggauauuaacaucaaagaccacucuauuguuuccagcuacguguguucugggcuugucggagacacgccccggaagaaugauagcuccucuagcucccauugccuggacccgaacaaugaagagggcggccacggggugaaaggaugggccuucgaugacggcaacgauguuuggauggggcgcaccaucagcgagaagucuagacucggauaugaaacauuuaaagugaucgagggcugguccaauccuaagagcaaacugcagauuaaccggcaggucaucguggaccgcgggaauagaucuggauacuccggcauuuucagcgucgaaggcaaguccuguaucaaccggugcuuuuauguggagcugauuagagggcgcaaggaagagaccgagguucucuggaccucuaauagcaucguggucuucuguggaacauccggcaccuacgggacaggaucuuggcccgauggcgcugacauuaaccugaugccuaucuga

SEQ ID NO: 203053 - RNA, 1410 nt, Artificial Sequence; identical to SEQ ID NO: 202279
  derived and/or modified sequence opt5 from neuraminidase__InfluenzaA__ADN92480

SEQ ID NO: 203054 - RNA, 1410 nt, Artificial Sequence; identical to SEQ ID NO: 202279
  derived and/or modified sequence opt5 from neuraminidase__InfluenzaA__ADN92491

SEQ ID NO: 203055 - RNA, 1410 nt, Artificial Sequence
  derived and/or modified sequence opt5 from neuraminidase__InfluenzaA__ADN92502
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggaacggagugaaaggcugggccuucgaugacgggaaugauguuuggaugggacgcaccaucagcgagaagucuagacucggcuaugagacauuuaaagugaucgaagggugguccaacccuaagagcaaacugcagauuaaucggcaggucaucguggaccgcggaaacagaucuggcuacuccggcauuuucagcgucgaggggaaguccuguaucaaucggugcuuuuauguggaacugauuagaggacgcaaggaggaaaacgagguucucuggaccucuaauagcaucguggucuucuguggcaccuccgggacauacggaaccggcucuuggcccgauggggcugacauuaaccugaugccuaucuga

SEQ ID NO: 203056 - RNA, 1410 nt, Artificial Sequence; identical to SEQ ID NO: 199762
  derived and/or modified sequence opt5 from neuraminidase__InfluenzaA__ADN92512

SEQ ID NO: 203057 - RNA, 1410 nt, Artificial Sequence; identical to SEQ ID NO: 199762
  derived and/or modified sequence opt5 from neuraminidase__InfluenzaA__ADN92522

SEQ ID NO: 203058 - RNA, 1410 nt, Artificial Sequence; identical to SEQ ID NO: 199762
  derived and/or modified sequence opt5 from neuraminidase__InfluenzaA__ADN92532

SEQ ID NO: 203059 - RNA, 1410 nt, Artificial Sequence; identical to SEQ ID NO: 199762
  derived and/or modified sequence opt5 from neuraminidase__InfluenzaA__ADN92542

SEQ ID NO: 203060 - RNA, 1410 nt, Artificial Sequence; identical to SEQ ID NO: 199762
  derived and/or modified sequence opt5 from neuraminidase__InfluenzaA__ADN92552

SEQ ID NO: 203061 - RNA, 1410 nt, Artificial Sequence; identical to SEQ ID NO: 199762
  derived and/or modified sequence opt5 from neuraminidase__InfluenzaA__ADO00733

SEQ ID NO: 203062 - RNA, 1410 nt, Artificial Sequence
  derived and/or modified sequence opt5 from neuraminidase__InfluenzaA__ADO00743
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgcgaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggcuaacggagucaagggcuucuccuuuaaguauggcaacgggguguggauuggaagaacaaaaagcaucuccucucggaauggcuucgagaugauuugggauccuaacggguggaccggaaccgacaauaacuuuagcauccgccaagacaucguuggcauuaaugaaugguccggguacucuggcagcuucgugcagcaucccgagcuuacaggacuggauuguaucagaccuugcuucugggucgaacucauucggggccgccccaaggagaacacgaucuggaccuccgggagcucuauuuccuuuuguggagugaauagcgacacaguuggcuggucuuggcccgauggggccgagcugccuuucaccaucgacaaauga

SEQ ID NO: 203063 - RNA, 1410 nt, Artificial Sequence; identical to SEQ ID NO: 200939
  derived and/or modified sequence opt5 from neuraminidase__InfluenzaA__ADO00753

SEQ ID NO: 203064 - RNA, 1410 nt, Artificial Sequence; identical to SEQ ID NO: 199762
  derived and/or modified sequence opt5 from neuraminidase__InfluenzaA__ADO12146

SEQ ID NO: 203065 - RNA, 1410 nt, Artificial Sequence; identical to SEQ ID NO: 199762
  derived and/or modified sequence opt5 from neuraminidase__InfluenzaA__ADO12156

SEQ ID NO: 203066 - RNA, 1410 nt, Artificial Sequence; identical to SEQ ID NO: 199762
  derived and/or modified sequence opt5 from neuraminidase__InfluenzaA__ADO12166

SEQ ID NO: 203067 - RNA, 1410 nt, Artificial Sequence; identical to SEQ ID NO: 199762
  derived and/or modified sequence opt5 from neuraminidase__InfluenzaA__ADO12176

SEQ ID NO: 203068 - RNA, 1410 nt, Artificial Sequence; identical to SEQ ID NO: 199762
  derived and/or modified sequence opt5 from neuraminidase__InfluenzaA__ADO12186

SEQ ID NO: 203069 - RNA, 1410 nt, Artificial Sequence; identical to SEQ ID NO: 199762
  derived and/or modified sequence opt5 from neuraminidase__InfluenzaA__ADO12196

SEQ ID NO: 203070 - RNA, 1410 nt, Artificial Sequence; identical to SEQ ID NO: 199762
  derived and/or modified sequence opt5 from neuraminidase__InfluenzaA__ADO12206

SEQ ID NO: 203071 - RNA, 1410 nt, Artificial Sequence; identical to SEQ ID NO: 199762
  derived and/or modified sequence opt5 from neuraminidase__InfluenzaA__ADO12216

SEQ ID NO: 203072 - RNA, 1410 nt, Artificial Sequence; identical to SEQ ID NO: 199762
  derived and/or modified sequence opt5 from neuraminidase__InfluenzaA__ADO12226

SEQ ID NO: 203073 - RNA, 1410 nt, Artificial Sequence; identical to SEQ ID NO: 199762
  derived and/or modified sequence opt5 from neuraminidase__InfluenzaA__ADO12246

SEQ ID NO: 203074 - RNA, 1410 nt, Artificial Sequence; identical to SEQ ID NO: 199762
  derived and/or modified sequence opt5 from neuraminidase__InfluenzaA__ADO12266

SEQ ID NO: 203075 - RNA, 1410 nt, Artificial Sequence
  derived and/or modified sequence opt5 from neuraminidase__InfluenzaA__ADO12276
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaauccggaagcugcggcccggucucuuccaauggggccaacggagugaagggcuucagcuuuaaguauggcaacgggguuuggauuggaagaaccaaauccaucucuagccggaauggcuucgagaugauuugggauccuaacggguggacaggaaccgacaauaacuuuuccaucaagcaagacaucgugggcauuaaugaauggucuggguacagcggcuccuucguccagcaucccgagcuuaccggacuggauuguauccgcccuugcuucuggguggaacucauuagaggccggcccaaagagaacacaaucuggacgagcgggucuuccauuagcuuuuguggaguuaauucugacaccgugggcugguccuggcccgauggggcugagcugccuuucacaaucgacaaguga

SEQ ID NO: 203076 - RNA, 1410 nt, Artificial Sequence; identical to SEQ ID NO: 199762
  derived and/or modified sequence opt5 from neuraminidase__InfluenzaA__ADO12286

SEQ ID NO: 203077 - RNA, 1410 nt, Artificial Sequence; identical to SEQ ID NO: 199762
  derived and/or modified sequence opt5 from neuraminidase__InfluenzaA__ADO12296

SEQ ID NO: 203078 - RNA, 1410 nt, Artificial Sequence; identical to SEQ ID NO: 199762
  derived and/or modified sequence opt5 from neuraminidase__InfluenzaA__ADO12306

SEQ ID NO: 203079 - RNA, 1410 nt, Artificial Sequence
  derived and/or modified sequence opt5 from neuraminidase__InfluenzaA__ADO12316
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcgaugggguuuggauuggaagaacaaaaagcaucuccucucggaacggcuucgagaugauuugggacccuaauggguggaccggaaccgacaacaauuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 203080 - RNA, 1410 nt, Artificial Sequence; identical to SEQ ID NO: 199762
  derived and/or modified sequence opt5 from neuraminidase__InfluenzaA__ADO12326

SEQ ID NO: 203081 - RNA, 1410 nt, Artificial Sequence; identical to SEQ ID NO: 199762
  derived and/or modified sequence opt5 from neuraminidase__InfluenzaA__ADO12336

SEQ ID NO: 203082 - RNA, 1410 nt, Artificial Sequence; identical to SEQ ID NO: 199762
  derived and/or modified sequence opt5 from neuraminidase__InfluenzaA__ADO12346

SEQ ID NO: 203083 - RNA, 1410 nt, Artificial Sequence; identical to SEQ ID NO: 199762
  derived and/or modified sequence opt5 from neuraminidase__InfluenzaA__ADO12356

SEQ ID NO: 203084 - RNA, 1410 nt, Artificial Sequence; identical to SEQ ID NO: 199762
  derived and/or modified sequence opt5 from neuraminidase__InfluenzaA__ADO12366

SEQ ID NO: 203085 - RNA, 1410 nt, Artificial Sequence; identical to SEQ ID NO: 199762
  derived and/or modified sequence opt5 from neuraminidase__InfluenzaA__ADO12376

SEQ ID NO: 203086 - RNA, 1410 nt, Artificial Sequence; identical to SEQ ID NO: 199762
  derived and/or modified sequence opt5 from neuraminidase__InfluenzaA__ADO12386

SEQ ID NO: 203087 - RNA, 1410 nt, Artificial Sequence; identical to SEQ ID NO: 199762
  derived and/or modified sequence opt5 from neuraminidase__InfluenzaA__ADO12396

SEQ ID NO: 203088 - RNA, 1410 nt, Artificial Sequence; identical to SEQ ID NO: 199762
  derived and/or modified sequence opt5 from neuraminidase__InfluenzaA__ADO12406

SEQ ID NO: 203089 - RNA, 1410 nt, Artificial Sequence; identical to SEQ ID NO: 200529
  derived and/or modified sequence opt5 from neuraminidase__InfluenzaA__ADO12416

SEQ ID NO: 203090 - RNA, 1410 nt, Artificial Sequence; identical to SEQ ID NO: 199762
  derived and/or modified sequence opt5 from neuraminidase__InfluenzaA__ADO12426

SEQ ID NO: 203091 - RNA, 1410 nt, Artificial Sequence; identical to SEQ ID NO: 199762
  derived and/or modified sequence opt5 from neuraminidase__InfluenzaA__ADO12436

SEQ ID NO: 203092 - RNA, 1410 nt, Artificial Sequence; identical to SEQ ID NO: 199762
  derived and/or modified sequence opt5 from neuraminidase__InfluenzaA__ADO12446

SEQ ID NO: 203093 - RNA, 1410 nt, Artificial Sequence; identical to SEQ ID NO: 199762
  derived and/or modified sequence opt5 from neuraminidase__InfluenzaA__ADO12456

SEQ ID NO: 203094 - RNA, 1410 nt, Artificial Sequence; identical to SEQ ID NO: 199762
  derived and/or modified sequence opt5 from neuraminidase__InfluenzaA__ADO12466

SEQ ID NO: 203095 - RNA, 1410 nt, Artificial Sequence; identical to SEQ ID NO: 199762
  derived and/or modified sequence opt5 from neuraminidase__InfluenzaA__ADO12476

SEQ ID NO: 203096 - RNA, 1410 nt, Artificial Sequence; identical to SEQ ID NO: 199762
  derived and/or modified sequence opt5 from neuraminidase__InfluenzaA__ADO12486

SEQ ID NO: 203097 - RNA, 1410 nt, Artificial Sequence; identical to SEQ ID NO: 199762
  derived and/or modified sequence opt5 from neuraminidase__InfluenzaA__ADO12496

SEQ ID NO: 203098 - RNA, 1410 nt, Artificial Sequence; identical to SEQ ID NO: 199762
  derived and/or modified sequence opt5 from neuraminidase__InfluenzaA__ADO12506

SEQ ID NO: 203099 - RNA, 1410 nt, Artificial Sequence; identical to SEQ ID NO: 199762
  derived and/or modified sequence opt5 from neuraminidase__InfluenzaA__ADO12516

SEQ ID NO: 203100 - RNA, 1410 nt, Artificial Sequence; identical to SEQ ID NO: 199762
  derived and/or modified sequence opt5 from neuraminidase__InfluenzaA__ADO12526

SEQ ID NO: 203101 - RNA, 1410 nt, Artificial Sequence; identical to SEQ ID NO: 199762
  derived and/or modified sequence opt5 from neuraminidase__InfluenzaA__ADO12536

SEQ ID NO: 203102 - RNA, 1410 nt, Artificial Sequence; identical to SEQ ID NO: 199762
  derived and/or modified sequence opt5 from neuraminidase__InfluenzaA__ADO12546

SEQ ID NO: 203103 - RNA, 1410 nt, Artificial Sequence; identical to SEQ ID NO: 199762
  derived and/or modified sequence opt5 from neuraminidase__InfluenzaA__ADO12556

SEQ ID NO: 203104 - RNA, 1410 nt, Artificial Sequence; identical to SEQ ID NO: 199762
  derived and/or modified sequence opt5 from neuraminidase__InfluenzaA__ADO12566

SEQ ID NO: 203105 - RNA, 1410 nt, Artificial Sequence; identical to SEQ ID NO: 199762
  derived and/or modified sequence opt5 from neuraminidase__InfluenzaA__ADO12576

SEQ ID NO: 203106 - RNA, 1410 nt, Artificial Sequence
  derived and/or modified sequence opt5 from neuraminidase__InfluenzaA__ADO12586
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauagcggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 203107 - RNA, 1410 nt, Artificial Sequence; identical to SEQ ID NO: 203106
  derived and/or modified sequence opt5 from neuraminidase__InfluenzaA__ADO12596

SEQ ID NO: 203108 - RNA, 1410 nt, Artificial Sequence; identical to SEQ ID NO: 199762
  derived and/or modified sequence opt5 from neuraminidase__InfluenzaA__ADO12606

SEQ ID NO: 203109 - RNA, 1410 nt, Artificial Sequence; identical to SEQ ID NO: 199762
  derived and/or modified sequence opt5 from neuraminidase__InfluenzaA__ADO12616

SEQ ID NO: 203110 - RNA, 1410 nt, Artificial Sequence; identical to SEQ ID NO: 199762
  derived and/or modified sequence opt5 from neuraminidase__InfluenzaA__ADO12626

SEQ ID NO: 203111 - RNA, 1410 nt, Artificial Sequence; identical to SEQ ID NO: 199762
  derived and/or modified sequence opt5 from neuraminidase__InfluenzaA__ADO14355

SEQ ID NO: 203112 - RNA, 1401 nt, Artificial Sequence
  derived and/or modified sequence opt5 from neuraminidase__InfluenzaA__ADO21028
augaaccccaaucagaagaucauugccaucggcagcgugucccugaccauugcuacaaucugcuuccucaugcaaauugccauccuggcgacgaccaugacacuucacuuuaaacagaacgaguguucuaauccuagcaacaaucaggucguuccgugcgaacccaccaucauugagagaaacaucgugcaucugaauagcacaaccauugaaaaggagaucuguccuaaaguggcugaauacaagaacuggucuaaaccccagugccaaauuacagggagcgccccuuucuccaagggaaauucuauccggcucagcgccggcggggacauuugggucacccgcgagcccuauguguccuguagccugggaaagugcuaccaguuugcucuuggccaggggacgacccugaaaaacaagcacucuaauggaacaacccaugauagaguuccucaccggacacuccugauguccgagcugggcgugccguuccaucucggcaccaaacaggucuguaucgccugguccucuuccagcugccacgacgggaaggcuuggcugcacguguguguuacgggagaugacaaaaacgccacagcgucuaucauuuaugauggcaugcuuguggacuccaucgggagcugguccaagaauauucugcgcacccaagaaucugagugcgucuguaucaacggaacaugcaccguggugaugaccgauggcagcgccuccgggaaggcugacacacggauucucuuuaucagagaaggaaaaaucguccauauuagcccccugucuggcuccgcccagcacguugaggagugcagcuguuacccucgcuaucccgaagugagaugcgugugucgggauaauuggaagggcucuaaccgcccuguccuuuacaucaacauggcugacuauagcauugaguccucuuacgugugcagcgggcugguuggagauacgcccagaaaugacgauuccuacucuagcuccaacugucgggacccgaauaacgaacgcggcgccccuggggugaaaggaugggcguucgacaauggcaacgauaucuggauggggagaaccauuaaggaggacagccggucuggauaugaaacauuucgcgucgugggcggcuggaccacagccaauuccaaaagccagaucaacagacagguuaucguggauuccgacaauuggucuggguacagcggaauuuucuccgucgagggcaagaacugcaucaaucgguguuuuuauguggagcucauuagagggcgcccccaagaaacccgggucugguggacgucuaacagcaucauuguguucugcggaacauccggcaccuacgggaccggcagcuggccugauggagcuaauaucaacuuuaugcccauuuga

SEQ ID NO: 203113 - RNA, 1401 nt, Artificial Sequence
  derived and/or modified sequence opt5 from neuraminidase__InfluenzaA__ADO21039
augaaccccaaucagaagaucauugccaucggcagcgugucccugaccauugcuacaaucugcuuccucaugcaaauugccauccuggcgacgaccaugacacuucacuuuaaacagaacgaguguucuaauccuagcaacaaucaggucguuccgugcgaacccaccaucauugagagaaacaucgugcaucugaauagcacaaccauugaaaaggagaucuguccuaaaguggcugaauacaagaacuggucuaaaccccagugccaaauuacagggagcgccccuuucuccaagggaaauucuauccggcucagcgccggcggggacauuugggucacccgcgagcccuauguguccuguagccugggaaagugcuaccaguuugcucuuggccaggggacgacccugaaaaacaagcacucuaauggaacaacccaugauagagacccucaccggacacuccugauguccgagcugggcguuccguuccaucucggcaccaaacagguguguaucgccugguccucuuccagcugccacgaugggaaggcuuggcugcacgucugugugacgggagacgauaaaaacgccacagcgucuaucauuuaugacggcaugcuuguugauuccaucgggagcugguccaagaauauucugcgcacccaagaaucugagugcguguguaucaacggaacaugcaccgucgugaugaccgacggcagcgccuccgggaaggcugauacacggauucucuuuaucagagaaggaaaaaucgugcauauuagcccccugucuggcuccgcccagcacgucgaggagugcagcuguuacccucgcuaucccgaaguuagaugcgugugucgggacaauuggaagggcucuaaccgcccugugcuuuacaucaacauggcugauuauacgauugagagcuccuacgucugcucugggcuggugggagacacccccagaaaugaugacagcuacuccagcucuaacugucgggacccgaauaacgaacgcggcgccccugggguuaaaggaugggcguucgauaauggcaacgacaucuggauggggagaacaauuaaggaggauucccggagcggauaugaaaccuuucgcguggucggcggcuggacaaccgccaauucuaaaucccagaucaacagacaggugaucguugacagcgauaauugguccggguacucuggaauuuucagcguggagggcaagaacugcaucaaucgguguuuuuaugucgagcucauuagagggcgcccccaagaaacgcgggugugguggacauccaacucuaucauugucuucugcggaaccagcggcaccuacgggacaggcuccuggccugacggagcuaauaucaacuuuaugcccauuuga

SEQ ID NO: 203114 - RNA, 1401 nt, Artificial Sequence
  derived and/or modified sequence opt5 from neuraminidase__InfluenzaA__ADO21050
augaaccccaaucagaagaucauugccaucggcagcgugucccugaccauugcuacaaucugcuuccucaugcaaauugccauccuggcgacgaccaugacacuucacuuuaaacagaacgaguguucuaauccuagcaacaaucaggucguuccgugcgaacccaccaucauugagagaaacaucgugcaucugaauagcacaaccauugaaaaggagaucuguccuaaaguggcugaauacaagaacuggucuaaaccccagugccaaauuacagggagcgccccuuucuccaagggaaauucuauccggcucagcgccggcggggacauuugggucacccgcgagcccuauguguccuguagccugggaaagugcuaccaguuugcucuuggccaggggacgacccugaaaaacaagcacucuaauggaacaacccaugauagaggcccucaccggacacuccugauguccgagcugggcguuccguuccaucucgggaccaaacagguguguaucgccugguccucuuccagcugccacgacggaaaggcuuggcugcacgucugugugacgggcgaugacaaaaacgccacagcgucuaucauuuaugaugggaugcuuguugacuccaucggaagcugguccaagaauauucugcgcacccaagaaucugagugcguguguaucaacggcacaugcaccgucgugaugaccgaugggagcgccuccggaaaggcugacacacggauucucuuuaucagagaaggcaaaaucgugcauauuagcccccugucuggcuccgcccagcacgucgaggagugcagcuguuacccucgcuaucccgaaguuagaugcgugugucgggauaauuggaaggggucuaaccgcccugugcuuuacaucaacauggcugacuauagcauugaguccucuuacgucugcagcggacuggugggcgauacgcccagaaaugacgauuccuacucuagcuccaacugucgggacccgaauaacgaaagcggggccccuggaguuaaaggcugggcguucgacaaugggaacgauaucuggaugggacgcaccauuaaggaggacucuagauccggcuaugaaacauuucggguggucggcggguggaccacagccaauagcaaaucccagaucaaccgccaggugaucguugauucugacaauuggagcggauacuccggcauuuucucuguggaggggaagaacugcaucaauagauguuuuuaugucgagcucauucggggaagaccccaagaaacccgcgugugguggacgagcaacuccaucauugucuucugcggcacaagcgggaccuacggcaccggaucuuggccugauggcgcuaauaucaacuuuaugcccauuuga

SEQ ID NO: 203115 - RNA, 1410 nt, Artificial Sequence
  derived and/or modified sequence opt5 from neuraminidase__InfluenzaA__ADO25095
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggagcggcuucgagaugaucugggauccuaauggguggaccggaaccgacaacaauuuuuccaucaagcaagacauuguuggcaucaacgaauggucuggguacagcggcuccuucgugcagcaucccgagcuuacaggacuggauuguauucgcccuugcuucugggucgaacucaucagaggccggcccaaagagaauacgauuuggaccagcgggucuuccaucagcuuuuguggagugaacucugacacaguuggcugguccuggcccgauggggcugagcugccuuucaccaucgacaaguga

SEQ ID NO: 203116 - RNA, 1410 nt, Artificial Sequence
  derived and/or modified sequence opt5 from neuraminidase__InfluenzaA__ADO25105
augaaccccaaucagaagaucauuaccaucggcagcgugugcaugacaauugggauggccaaccugauccuccaaauuggaaauaucaucuccauuuggaucucucacagcauucagcugggcaaccagaaucagaucgggacguguaaccaauccgucauuaccuacgagacaaauaccuggguuaaccagacauaugugaauaucucuaacaccaauuucgcugccggacagagcguggucuccgugaaacuugcgggcaacucuagccugugcccuguuuccgggugggcuauuuacagcaaggacaauucuaucagaaucggauccaaaggcgauguguuugucauucgggaaccguucaucagcuguucuccccucgagugccgcacauuuuuccugacccagggcgcccuucugaacgacaagcauuccaaugggacgauuaaagauagaagcccuuaucggacccucaugucuugucccaucggagaagugccuucccccuacaacagccgcuuugaguccguugccuggucugcuagcgccugccacgacggcauuaacuggcugacaaucgggaucuccggaccugauaauggcgcuguggccguccugaaguauaacgggauuaucaccgacacaauuaagagcuggagaaauaacauccuccggacccaagaaucugagugugcgugcgugaauggauccuguuucacggugaugacagauggcccgagcgaccgccaggccucuuacaaaauuuuuagaaucgagaagggcaaaaucgucaagagcguugaaaugaacgcucccaauuaucauuacgaggaaugcuccuguuacccugauucuagcgagauuaccugcgugugccgggacaacuggcacggguccaaucgccccugggugagcuucaaccagaaucuggaguaucagaucggauacauuuguucuggcaucuuuggggauaacccuagacccaaugacaaaacaggauccugcggcccggucagcucuaacggggccaauggagugaagggcuucuccuuuaaguauggcaacgggguuuggauuggacggaccaaaagcaucuccucucgcaacggcuucgaaaugauuugggauccuaauggguggaccggaacagacaacaauuuuagcaucaagcaagacaucgugggcauuaacgagugguccggguacucuggcagcuucguccagcaucccgaacuuacgggacuggauuguaucagaccuugcuucuggguggagcucauucggggccgccccaaagaaaauaccaucuggacauccgggagcucuauuuccuuuuguggaguuaacagcgacaccgugggcuggucuuggcccgauggggcugagcugccuuucacaaucgacaaguga

SEQ ID NO: 203117 - RNA, 1410 nt, Artificial Sequence; identical to SEQ ID NO: 201543
  derived and/or modified sequence opt5 from neuraminidase__InfluenzaA__ADO25115

SEQ ID NO: 203118 - RNA, 1410 nt, Artificial Sequence; identical to SEQ ID NO: 201543
  derived and/or modified sequence opt5 from neuraminidase__InfluenzaA__ADO25125

SEQ ID NO: 203119 - RNA, 1410 nt, Artificial Sequence
  derived and/or modified sequence opt5 from neuraminidase__InfluenzaA__ADO25135
augaaccccaaucagaagaucauuaccaucggcagcgugugcaugacaauugggauggccaaccugguccuccaaaucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 203120 - RNA, 1410 nt, Artificial Sequence; identical to SEQ ID NO: 201113
  derived and/or modified sequence opt5 from neuraminidase__InfluenzaA__ADO25145

SEQ ID NO: 203121 - RNA, 1410 nt, Artificial Sequence; identical to SEQ ID NO: 199762
  derived and/or modified sequence opt5 from neuraminidase__InfluenzaA__ADO25155

SEQ ID NO: 203122 - RNA, 1410 nt, Artificial Sequence; identical to SEQ ID NO: 199762
  derived and/or modified sequence opt5 from neuraminidase__InfluenzaA__ADO25165

SEQ ID NO: 203123 - RNA, 1410 nt, Artificial Sequence; identical to SEQ ID NO: 199762
  derived and/or modified sequence opt5 from neuraminidase__InfluenzaA__ADO25175

SEQ ID NO: 203124 - RNA, 1410 nt, Artificial Sequence
  derived and/or modified sequence opt5 from neuraminidase__InfluenzaA__ADO25185
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcauguccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 203125 - RNA, 1410 nt, Artificial Sequence; identical to SEQ ID NO: 202191
  derived and/or modified sequence opt5 from neuraminidase__InfluenzaA__ADO25195

SEQ ID NO: 203126 - RNA, 1410 nt, Artificial Sequence; identical to SEQ ID NO: 200899
  derived and/or modified sequence opt5 from neuraminidase__InfluenzaA__ADO25205

SEQ ID NO: 203127 - RNA, 1410 nt, Artificial Sequence; identical to SEQ ID NO: 201113
  derived and/or modified sequence opt5 from neuraminidase__InfluenzaA__ADO25215

SEQ ID NO: 203128 - RNA, 1410 nt, Artificial Sequence; identical to SEQ ID NO: 199762
  derived and/or modified sequence opt5 from neuraminidase__InfluenzaA__ADO25225

SEQ ID NO: 203129 - RNA, 1410 nt, Artificial Sequence; identical to SEQ ID NO: 201113
  derived and/or modified sequence opt5 from neuraminidase__InfluenzaA__ADO25235

SEQ ID NO: 203130 - RNA, 1410 nt, Artificial Sequence; identical to SEQ ID NO: 199762
  derived and/or modified sequence opt5 from neuraminidase__InfluenzaA__ADO25245

SEQ ID NO: 203131 - RNA, 1410 nt, Artificial Sequence; identical to SEQ ID NO: 199762
  derived and/or modified sequence opt5 from neuraminidase__InfluenzaA__ADO25255

SEQ ID NO: 203132 - RNA, 1410 nt, Artificial Sequence; identical to SEQ ID NO: 201543
  derived and/or modified sequence opt5 from neuraminidase__InfluenzaA__ADO25265

SEQ ID NO: 203133 - RNA, 1410 nt, Artificial Sequence; identical to SEQ ID NO: 201354
  derived and/or modified sequence opt5 from neuraminidase__InfluenzaA__ADO25275

SEQ ID NO: 203134 - RNA, 1410 nt, Artificial Sequence; identical to SEQ ID NO: 201113
  derived and/or modified sequence opt5 from neuraminidase__InfluenzaA__ADO25285

SEQ ID NO: 203135 - RNA, 1413 nt, Artificial Sequence
  derived and/or modified sequence opt5 from neuraminidase__InfluenzaA__ADO27623
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguugccgcgggagaagacaaaaccucugugacacuggcuggcaacagcucccuuuguagcauuucugggugggccaucuacaccaaggauaauuccauucggaucggaagcaaaggcgacguguucgucauucgcgagccuuuuaucucuugcucccaccuggaauguagaacguucuuucucacccaaggcgcccugcuuaacgauaagcauagcaaugggacagugaaagaccggucuccguaucgcgcucugauguccugcccccucggagaggccccuagccccuacaacuccaaguucgaaucuguugcuuggagcgccuccgcgugucacgauggcaugggguggcugaccaucggaauuagcggcccugacaacggggccguggcuguccugaaguauaauggaaucauuacaggcaccaucaaaucuuggaagaaacagauucucagaacgcaggaguccgagugcguguguaugaacggcagcugcuuuacaaucaugaccgaugggcccucuaauaaggccgcuagcuacaaaaucuucaagauugaaaagggaaaaguuacaaaguccaucgagcugaacgccccuaauuuuuauuacgaagaguguucuugcuacccggacaccggcauugugaugugugucugccgggauaacuggcaugggagcaaucgccccuggguguccuucaaccagaaucuugacuaucaaaucggauacauuugcagcggcguguuuggggauaacccuagacccgaggacggagaaggcucuuguaauccugucaccguugauggcgcgaacggggugaaaggauucuccuauaaguacggcaaugggguguggaucggacggacaaaaagcaaccgccugagaaagggcuuugagaugauuugggaccccaauggguggacgaacaccgacucugauuucuccgucaaacaggacgugguugccaucacagauuggagcggcuauuccggaucuuuugugcagcacccggaacucaccggccuggacugcauccggccuuguuucugggucgagcuugugcgcgggcugcccagagaaaacacaaccauuuggacgagcggauccucuaucagcuucugcggcguuaauuccgauacagcuaacuggagcuggccugacggggccgagcuccccuuuaccauugauaaguga

SEQ ID NO: 203136 - RNA, 1410 nt, Artificial Sequence; identical to SEQ ID NO: 199762
  derived and/or modified sequence opt5 from neuraminidase__InfluenzaA__ADO30410

SEQ ID NO: 203137 - RNA, 1410 nt, Artificial Sequence; identical to SEQ ID NO: 201113
  derived and/or modified sequence opt5 from neuraminidase__InfluenzaA__ADO30420

SEQ ID NO: 203138 - RNA, 1410 nt, Artificial Sequence; identical to SEQ ID NO: 200470
  derived and/or modified sequence opt5 from neuraminidase__InfluenzaA__ADP95343

SEQ ID NO: 203139 - RNA, 1410 nt, Artificial Sequence; identical to SEQ ID NO: 199752
  derived and/or modified sequence opt5 from neuraminidase__InfluenzaA__ADP95353

SEQ ID NO: 203140 - RNA, 1410 nt, Artificial Sequence; identical to SEQ ID NO: 199752
  derived and/or modified sequence opt5 from neuraminidase__InfluenzaA__ADP95363

SEQ ID NO: 203141 - RNA, 1410 nt, Artificial Sequence; identical to SEQ ID NO: 199752
  derived and/or modified sequence opt5 from neuraminidase__InfluenzaA__ADP95373

SEQ ID NO: 203142 - RNA, 1410 nt, Artificial Sequence; identical to SEQ ID NO: 199752
  derived and/or modified sequence opt5 from neuraminidase__InfluenzaA__ADP95383

SEQ ID NO: 203143 - RNA, 1410 nt, Artificial Sequence; identical to SEQ ID NO: 199752
  derived and/or modified sequence opt5 from neuraminidase__InfluenzaA__ADP95393

SEQ ID NO: 203144 - RNA, 1410 nt, Artificial Sequence
  derived and/or modified sequence opt5 from neuraminidase__InfluenzaA__ADQ43774
augaaccccaaucagaagaucauuaccaucggcagcgggugcaugacaauuggaauggccaaccugauccuccaaauuggcaauaucaucuccauuuggaucucucacagcauucagcuggggaaccagaaucagaucgagacguguaaccaauccgugauuaccuacgaaaauaacacaugggucaaucagaccuauguuaacaucucuaauacaaacuucgcugccggacagagcgugguguccgucaaacuugcgggcaauucuagccugugcccuguguccgggugggcuauuuacagcaaggacaacucuaucagaaucggauccaaaggcgauguuuuugugauucgggagccguucaucagcuguucuccccucgaaugccgcaccuuuuuccugacacagggcgcccuucugaaugacaagcauuccaacgggaccauuaaagauagaagcccuuaucggacgcucaugucuugucccaucggagaggucccuucccccuacaacagccgcuuugaauccguggccuggucugcuagcgccugccacgacggcauuaauuggcugaccaucgggaucuccggaccugauaacggcgcuguugccgugcugaaguauaaugggauuaucacagacaccauuaagagcuggagaaacaauauccuccggacacaagagucugagugugcgugcgucaacggauccuguuucaccgugaugacggauggcccgagcgacggccaggccucuuacaaaauuuuucgcaucgaaaaggggaaaaucgucaagagcguggagaugaaagcucccaauuaucauuacgaagagugcuccuguuacccugauucuagcgagauuacaugcguuugcagagacaacuggcacggauccaaucggcccugggugagcuucaaccagaaucuggaauaucagaucggcuacauuuguucugggaucuuuggagauaacccucgccccaaugacaagaccggcuccugcgggccggugagcucuaacggagccaauggcgucaagggcuucuccuuuaaauaugggaacggaguguggauuggcagaacaaagagcaucuccucucggaacggguucgagaugauuugggauccuaauggauggaccggcaccgacaacaauuuuagcaucaaacaagacaucguugggauuaacgaaugguccggcuacucuggcagcuucgugcagcaucccgagcuuacaggacuggauuguauccgcccuugcuucugggucgaacucauuagagggcggcccaaggagaauacgaucuggaccuccggaagcucuauuuccuuuuguggcgugaacagcgacacaguuggguggucuuggcccgauggagcugagcugccuuucaccaucgacaaauga

SEQ ID NO: 203145 - RNA, 1410 nt, Artificial Sequence
  derived and/or modified sequence opt5 from neuraminidase__InfluenzaA__ADQ92578
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuauucuuugugaacccacaaucauugagagaaauaucaccgaaauuguguaucugacaaacgcuaccaucgagaaggaaauuugcccuaaacucgccgaguaccggaauugguccaagccccagugugacaucacgggguucgcgccuuuuucuaaagauaacagcauccgccuguccgcuggaggcgacauuugggugaccagagagcccuaugucucuugcgauccugacaaguguuaccaauucgcccuugggcagggaacaacccugaauaacgugcauagcaauaacacaguucgggaucgcaccccguauagaacgcuccugaugaaugaacugggcgugcccuuucaccucgggacaaagcaggucugcaucgccugguccucuagcuccugucaugacggaaaggcuuggcugcacgugugcauuaccggcgaugacaaaaacgccacagcuagcuucaucuacaauggccggcuuguugauucuguggucuccuggagcaaagagauucugcgcacccaggaaucugagugugugugcaucaacgggaccuguacaguggucaugacggacggauccgccagcggcaaggcggauaccaaaauccucuuuauugaggaagggaagaucguucauacauccacccugucuggaagcgcccaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucagcgagaagucuagacucggcuaugagacguuuaaagugauugaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaacagagguucucuggaccucuaauagcauuguggucuucuguggcaccuccgggacauacggaaccggcucuuggcccgauggggccgacaucaaccugaugccuaucuga

SEQ ID NO: 203146 - RNA, 1410 nt, Artificial Sequence; identical to SEQ ID NO: 199623
  derived and/or modified sequence opt5 from neuraminidase__InfluenzaA__ADR32364

SEQ ID NO: 203147 - RNA, 1410 nt, Artificial Sequence
  derived and/or modified sequence opt5 from neuraminidase__InfluenzaA__ADT64478
augaaccccaaucagaagaucauuaccaucggcagcgugugcaugacaauugggauggccaaccugauccuccaaauuggaaauaucaucuccauuuggaucggccacucuauucagcuggggaaccagaaucagaucgagacguguaaccaaagcgucauuaccuacgaaaauaacacauggguuaaucagaccuaugugaacaucuccaauacaaacuucgcugccggacagucuguggucagcgugaaacuugcgggcaauuccucucugugcccuguuagcgggugggcuauuuacuccaaggacaacagcgugagaaucggaucuaaaggcgaugucuuugugauccgggagccguucauuuccuguagcccccucgaaugccgcaccuuuuuccugacacagggcgcccuucugaaugacaagcauucuaacgggaccaucaaagauagauccccuuaucggacgcucaugagcugucccauuggagagguuccuucucccuacaacucccgcuuugaaagcguggccugguccgcuucugccugccacgacggcaucaauuggcugaccauugggaucagcggaccugauaacggcgcugucgccgugcugaaguauaaugggaucauuacagacaccaucaaguccuggagaaacaauauucuccggacacaagagagcgagugugcgugcgugaacggaucuuguuucaccgucaugacggauggcccguccaauggccaggccagcuacaaaaucuuucgcauugaaaaggggaaaaucguuaagucuguggagaugaacgcucccaauuaucauuacgaagagugcagcuguuacccugacuccucugagaucacaugcgugugcagagauaacuggcacggaagcaaucggcccugggucuccuucaaccagaaucuggaauaucagauuggcuacaucuguagcgggauuuuuggagacaacccucgccccaaugauaaaaccggcucuugcgggccgguguccagcaacggagccaacggcguuaagggcuucucuuuuaaguaugggaauggaguguggaucggcagaacaaaauccauuagcucccggaacggguucgagaugaucugggacccuaauggauggaccggcaccgauaacaauuuuucuauuaagcaagacaucgucgggaucaacgaauggagcggcuacuccggaucuuucgugcagcaucccgagcuuacaggccuggacuguauucgcccuugcuucuggguugaacucaucagagggcggcccaaagagaauacgauuuggaccagcggauccagcaucucuuuuuguggcgugaacuccgauacagucggguggagcuggcccgacggagcugagcugccuuucaccauugauaaguga

SEQ ID NO: 203148 - RNA, 1410 nt, Artificial Sequence
  derived and/or modified sequence opt5 from neuraminidase__InfluenzaA__ADT78889
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugccaaaucaccggguucgcgccuuuuucuaaagauaauagcauucgccucuccgcuggaggcgacaucugggugacgagagagcccuacgucucuugugauccugggaagugcuaucaguucgcccugggacagggcaccacacuugacaacaagcacagcaaugauaccauccaugaccggauuccgcaccgcacacugcucaugaacgaacugggggugcccuuucaucugggaaccagacagguuuguguggccugguccucuagcuccugccacgauggcaaggcuuggcuccacgucugugugacgggcgacgauaaaaaugccacagcuagcuucaucuacgacgggcggcugguggauucuauuggauccuggagccaaaacauccuucgcacccaggagucugaaugcgucuguauuaauggcacaugcaccguugugaugaccgacggguccgccagcggcagagcggauacacggauccuguuuaucgaggagggaaaaauugugcauaucuccccucucucugggagcgcccagcacgucgaagagugcuccuguuauccccgcuacccugacgugagaugcauuugucgggacaacuggaagggaagcaaucgccccguuaucgauauuaacauggaagacuauucuaucgauuccagcuacgugugcucuggccuggucggcgacacgccgagaaacgaugaccggagcuccaauucuaacugucgcgauccuaauaacgagagagggaaucccggagugaaaggcugggcuuucgacaacggggaugacguuuggaugggacggaccaucagcaaggaucuuagauccggcuacgaaacauuuaaggugauugggggauggagcaccccuaauucuaaaucccagaucaaccgccaagucauuguggacagcaauaacuggucuggcuauuccggcaucuucagcgucgaggggaaguccugcauuaaucgguguuuuuacguggagcugaucagaggacgccagcaggaaacacggguuugguggaccucuaacagcauuguggucuucugcggcacguccgggacauauggaaccggcucuuggcccgacggggccaauaucagcuuuaugcccaucuga

SEQ ID NO: 203149 - RNA, 1410 nt, Artificial Sequence
  derived and/or modified sequence opt5 from neuraminidase__InfluenzaA__ADT78899
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuaugagagaacccuacgugucuuguaacccugggaaaugcuaucaguucgcccugggacagggcacgacccuugauaauaagcacagcaacgggacaauccaugaccggauuccgcaccgcacccugcucaugaaugagcugggaguccccuuucaucugggcacaaaacagguguguguugcuugguccucuagcuccugccacgauggcaaggccuggcuccacgugugugucaccggggacgauagaaacgcuacggccagcuucaucuacgacggacggcugguggauucuauuggcuccuggagccaaaauauccuucgcacacaggaaucugagugcguguguauuaacgggaccugcacagucguuaugaccgacggauccgcgagcggcagagccgauacccggauccuguuuaucaaggaggggaaaauugugcauaucuccccucucucuggaagcgcucagcacauugaagagugcuccuguuauccccgcuacccugacgugagaugcaucugucgggauaauuggaagggcagcaaccgccccgucauugacaucaacauggaagacuauucuaucgauuccagcuacgugugcucuggccugguuggggacacaccgagaaaugaugacagcuccucuaacagcaauugucgggauccuaacaaugagcgcggaaaccccggcgugaaagggugggccuucgacaauggagaugacgucuggaugggcagaacgauuuccaaggaucuucggagcggguacgaaaccuuuaaggugaucggaggcuggucuacaccuaacuccaaaagccagguuaauagacaagugauugucgacaacaauaacuggucuggcuauuccgggaucuucagcguggagggaaaguccugcauuaaucgcuguuuuuacgucgagcugauccggggcagaccccaggaaacccgcgugugguggacaucuagcuccauuguuguguucugcgggaccucuggaacguauggcacagggagcuggcccgauggcgcuaacaucaauuuuaugccuaucuga

SEQ ID NO: 203150 - RNA, 1410 nt, Artificial Sequence
  derived and/or modified sequence opt5 from neuraminidase__InfluenzaA__ADT78963
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugauaccauccaugaccggauuccgcaccgcacacugcucaugaacgagcuggggguccccuuucaucugggaaccagacagguguguguugcuugguccucuagcuccugccacgauggcaaggccuggcuccacgugugugucacgggcgacgaucggaaugcuacagccagcuucaucuacgacgggcgccugguggauucuauuggauccuggagccaaaacauccuuagaacccaggaaucugagugcguguguauuaauggcacaugcaccgucguuaugaccgacggguccgcgagcggacgggccgauacacgcauccuguuuaucaaagagggcaagauugugcauaucuccccucucucugggagcgcucagcacguggaagagugcuccuguuaucccagauacccugacguccggugcauuugucgcgacaacuggaaaggaagcaauagacccgugaucgauauuaacauggaagacuauucuaucgauuccagcuacguuugcucuggccuggugggcgacacgccgcggaacgaugaccgcagcuccaauucuaacuguagagauccuaauaacgagcgggggaaucccggagucaagggcugggccuucgacaacgggaaugauguguggaugggaagaaccaucagcaaagaccuucgcuccggcuacgaaacauuuaagguuauugggggauggagcaccccuaacucuaagucccaggugaaucggcaagucaucguggauaacaauaacuggagcggcuauucuggcauuuucuccgucgaggggaaaagcugcaucaauagauguuuuuacguggagcugauucgcggacggcagcaggaaacaagaguuugguggaccuccaacucuaucguggucuucugcggcacgagcgggacauauggaaccggcuccuggcccgacggggcuaauauuaacuuuaugcccaucuga

SEQ ID NO: 203151 - RNA, 1410 nt, Artificial Sequence
  derived and/or modified sequence opt5 from neuraminidase__InfluenzaA__ADT79001
augaaccccaaucagaagaucauuaccaucggcagcauuucccugacaaucgccacgauuugcuuccucaugcaaaucgcuauccuggugaccacagucacccuucacuuuaaacaguacgagugugacucuccugccaacaaucagguuaugccgugcgaacccauuaucauugagagaaacaucacagaaauuguguaucugaccaauacaaccaucgagaaggaaauuuguccuaaacucguggaguaccggaacuggagcaagccccagugcaaaaucacgggguucgcgccuuuuuccaaggauaauucuauccgccugagcgcuggaggcgacauuugggucaccagagagcccuauguguccugugauccugggaagugcuaccaauucgcccuuggacagggcacaacccuggacaacaaacauucuaaugauacaauccacgaccggauuccgcaucgcacccuccugaugaacgaacuggggguucccuuucaccucggaacgagacagguguguaucgccuggagcuccagcucuugccaugauggcaaggcuuggcugcacgucugugugacaggcgacgauaaaaaugccaccgcuuccuucauuuaugacgggcggcuuguugauagcaucggaucuuggucccagaacauccugcgcacacaagagagcgaaugcguguguauuaaugggaccugcaccgucgugaugacagacggcucugccuccggaaaggcggauacgagaauccucuuuauugaggagggcaaaaucgugcacauuagcccucuguccgggucugcccagcaugucgaagagugcagcuguuacccccgguauccuggaguucgcugcaucuguagagacaacuggaagggcuccaaucggcccgugguggacaucaacgucaaggauuacagcauugacucuuccuacgugugcagcggccuuguuggggauaccccgcgcaacaaugacagaucuagcuccucuuauugucggaacccuaauaacgaacgcggaaaucacggcgugaaagggugggcuuucgaugacggaaacgaugucuggaugggcagaacaaucagcaaggacucccggagcggguacgagaccuuuaaagugauuggaggcuggucuacacccaauuccaagagccagaucaacagacagguuauuguggauucugacaaucgcuccggcuauagcgggaucuucuccgucgaaggaaaaucuugcauuaaccgguguuuuuacguggagcugaucagaggccgcgagcaagaaacccgggucugguggacgagcaauuccaucgugguuuucugcgggacaucuggaaccuauggcaccgggagcuggccugauggcgccgacauuaaccucaugcccaucuga

SEQ ID NO: 203152 - RNA, 1410 nt, Artificial Sequence; identical to SEQ ID NO: 197142
  derived and/or modified sequence opt5 from neuraminidase__InfluenzaA__ADT79021

SEQ ID NO: 203153 - RNA, 1410 nt, Artificial Sequence
  derived and/or modified sequence opt5 from neuraminidase__InfluenzaA__ADT79041
augaaccccaaucagaagaucauuaccaucggcagcgugucccugacaauugccacggucugcuuccucaugcaaaucgcuauucugguuaccacagugacccuucacuuuagacaguacgagugugacucuccugccaacaaucaggugaugccgugcgaacccaucaucauugagcggaacaucacagaaauugucuaucugaauaacaccacaaucgagaaagaaauuuguccuaagcucguggaguaccgcaauuggagcaaaccccagugcaagaucaccggguucgcgccuuuuuccaaagauaacucuauuagacugagcgcuggaggcgacaucuggguuacgcgggagcccuauguguccugugauccugggaagugcuaccaauucgcccuuggacagggcaccacacuggacaauaagcauucuaacgauaccauccacgaccgcauuccgcauagaacacuccugaugaaugaacuggggguccccuuucaccucggaacccgccagguguguaucgccuggagcuccagcucuugccaugauggcaaggcuuggcugcacguuugugugacgggcgacgauaaaaacgccacagcuuccuucauuuaugacgggcggcuugucgauagcaucggaucuuggucccagaauauucugagaacccaagagagcgaaugcguguguaucaacggcacaugcaccguggucaugaccgacgggucugccuccggacgggcggauacaaaaauccucuuuauugaggagggcaagaucguucacauuagcccucuguccgggucugcccagcauguggaagagugcagcuguuacccccgcuauccuggagugagaugcaucugucgggacaauuggaaaggcuccaaccgccccgucguggacauuaacguugaagauuacagcaucgacucuuccuacgugugcagcggccuugucggggauacgccgagaaauaacgaccggucuagcaauuccaacugucgcaauccuaacaaugagagaggaaaccacggcgugaaggggugggcuuucgaugacggaaaugauguuuggaugggccggaccaucucuaaggaccugagaagcggguaugaaacauuuaaagugauuggaggcugguccacccccaacagcaagucucagaucaaucgccaggucauuguggauuccgacaaccggagcggcuacucugggaucuucuccgucgagggaaaaagcugcauuaauagauguuuuuauguggagcucauccgcggccgggaacaagagacaagaguuugguggaccuccaacucuauuguggucuucugcgggacgagcggaacauacggcaccggguccuggccugauggcgccgacaucaaucugaugcccaucuga

SEQ ID NO: 203154 - RNA, 1410 nt, Artificial Sequence; identical to SEQ ID NO: 198784
  derived and/or modified sequence opt5 from neuraminidase__InfluenzaA__ADT79121

SEQ ID NO: 203155 - RNA, 1410 nt, Artificial Sequence
  derived and/or modified sequence opt5 from neuraminidase__InfluenzaA__ADT79131
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcuggaagacucuauuggcuccuggagccaaaacauccuucgcacccaggagucugagugcguguguauuaaugggacaugcaccguggucaugaccgauggauccgcgagcggcagagccgacacacggauccuguuuaucaaggaagggaaaauuguucauaucuccccucucucuggaagcgcucagcacauugaggaaugcuccuguuauccccgcuacccugaugugagaugcaucugucgggacaacuggaagggcagcaaucgccccgugcuggacauuucuauggaggauuauuccaucgacagcucuuacgucugcagcggccuugugggggauacgccgagaaacgacgauuccucuagcaacuccaauugucgggacccuaacaaugaacgcggaaaccccggcguuaaagggugggccuucgauaauggagacgauguguggaugggcagaaccaucagcaaggaccugcggucuggguacgagacauuuaaggucauuggaggcugguccaccccuaacagcaaaucucaggugaauagacaaguuaucguggauaacaauaacugguccggcuauagcgggauuuucuccgucgagggaaagucuugcaucaaucgcuguuuuuacguggaacucauucggggcagaagccaggagacacgcgucugguggaccuccaacucuaucgugguuuucugcgggacgagcggaacauauggcaccggguccuggcccgacggcgcuaauauuaacuuuaugcccaucuga

SEQ ID NO: 203156 - RNA, 1410 nt, Artificial Sequence; identical to SEQ ID NO: 199762
  derived and/or modified sequence opt5 from neuraminidase__InfluenzaA__ADT79234

SEQ ID NO: 203157 - RNA, 1410 nt, Artificial Sequence; identical to SEQ ID NO: 199752
  derived and/or modified sequence opt5 from neuraminidase__InfluenzaA__ADT79244

SEQ ID NO: 203158 - RNA, 1410 nt, Artificial Sequence
  derived and/or modified sequence opt5 from neuraminidase__InfluenzaA__ADU25480
augaaccccaaucagaagaucauuaucauuagcuccaucugccugauuaacggcaucaccucucucauccugcaaauugggaauaucauuagcaucuggauuucccacucuauccagauuggaaaccagaaucagacagagacguguagccaaaacaucaucaccuacgaaaauaacacaugggugaaucagaccuaugucaacauuuccaauaacaauuucguugccgagcaggcuguggugucuaugaaacuugccggcagcuccccucugugcccggucagcgggugggcgaucuacucuaaggacaacuccgugagaauuggaagcaaaggcgauguuuuugugauccgggaacccuucauuucuuguucccaucucgagugccgcacauuuuuccugacccagggggcccuucugaaugacaagcacagcaacggaacaaucaaagauagaucuccuuaucggacccucauguccugucccaucggcgaagucccuagccccuacaacucccgcuuugagucuguggcuuggagcgccuccgcuugccaugacggcacgagcuggcugaccauugggaucucuggaccugauaauggcgccguugcugugcugaaguauaacgacauuaucacagauaccauuaaguccuggagaaauaacauccuccggacacaagagagcgaaugugucugcgugaaugggucuuguuucaccgugaugacggacggaccgagcaacggccaggccuccuacaaaaucuuuaagauugagaaagggaaggucguuaaaucuguggaacugaaugcgcccaacuaucacuacgaggagugcagcuguuacccugauuccggagaaaucauuugcgugugccgcgacaauuggcauggcagcaacagacccugggucucuuucaaucagaaccuugaguaucagaucggcuacauuuguuccgggauccugggagauaauccucggcccaacgaccgcacaggcagcugcgggccggugucucucaauggagccaacggcguuaagggguuuuccuucaaguauggaaacggcguguggauuggcagaaccaaaagcuccucuagccgguccggguuugaaaugaucugggauccuaauggauggacagagaccgacaacaauuuccuggucaagcaagacaucgugggcaugaccgauuggucuggguacagcggauccuuuguucagcaccccgaacuuacaggcaugaacuguaugcgcccuugcuucuggguggagcugauuagagggcggcccaaagagaauacgaucuggaccagcggaucuuccauuagcuucuguggcgucaacucugacacaguggauugguccuggcccgacggcgcugaacucccuuuuaccaucgauaaguga

SEQ ID NO: 203159 - RNA, 1410 nt, Artificial Sequence; identical to SEQ ID NO: 199762
  derived and/or modified sequence opt5 from neuraminidase__InfluenzaA__ADU59780

SEQ ID NO: 203160 - RNA, 1410 nt, Artificial Sequence
  derived and/or modified sequence opt5 from neuraminidase__InfluenzaA__ADU59789
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacgugucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 203161 - RNA, 1410 nt, Artificial Sequence; identical to SEQ ID NO: 199762
  derived and/or modified sequence opt5 from neuraminidase__InfluenzaA__ADU59829

SEQ ID NO: 203162 - RNA, 1410 nt, Artificial Sequence
  derived and/or modified sequence opt5 from neuraminidase__InfluenzaA__ADU59838
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuucgaagagugcuccuguuacccugauucuagcgagaucacgugcgugugcagagacaauuggcacggguccaaccggcccugggugagcuuuaaucagaaccuggaauaccagauuggauauaucuguucuggcauuuucggggauaauccucgccccaacgacaaaacaggauccugcggcccggucagcucuaauggggccaacggagugaagggcuuuuccuucaaguacggcaacgggguuuggaucggaagaaccaaaagcauuuccucucggaauggcuuugagaugaucugggauccuaacggguggacaggaaccgacaauaacuucagcaucaagcaagacauugugggcaucaaugaaugguccggguauucuggcagcuucguccagcaucccgagcuuaccggacuggauuguauucgcccuugcuuuuggguggaacucaucagaggccggcccaaagagaacacaauuuggacguccgggagcucuaucuccuucuguggaguuaauagcgacaccguggauuggucuuggcccgacggcgcugagcugccuuuuacaaucgauaaguga

SEQ ID NO: 203163 - RNA, 1410 nt, Artificial Sequence; identical to SEQ ID NO: 201113
  derived and/or modified sequence opt5 from neuraminidase__InfluenzaA__ADU59847

SEQ ID NO: 203164 - RNA, 1410 nt, Artificial Sequence; identical to SEQ ID NO: 199762
  derived and/or modified sequence opt5 from neuraminidase__InfluenzaA__ADU59907

SEQ ID NO: 203165 - RNA, 1410 nt, Artificial Sequence; identical to SEQ ID NO: 199762
  derived and/or modified sequence opt5 from neuraminidase__InfluenzaA__ADU59917

SEQ ID NO: 203166 - RNA, 1410 nt, Artificial Sequence; identical to SEQ ID NO: 199762
  derived and/or modified sequence opt5 from neuraminidase__InfluenzaA__ADU59920

SEQ ID NO: 203167 - RNA, 1410 nt, Artificial Sequence; identical to SEQ ID NO: 199762
  derived and/or modified sequence opt5 from neuraminidase__InfluenzaA__ADU59941

SEQ ID NO: 203168 - RNA, 1410 nt, Artificial Sequence
  derived and/or modified sequence opt5 from neuraminidase__InfluenzaA__ADU76311
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcuaagcugccuuucaccaucgacaaauga

SEQ ID NO: 203169 - RNA, 1410 nt, Artificial Sequence
  derived and/or modified sequence opt5 from neuraminidase__InfluenzaA__ADU76313
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcuaagcugccuuucaccaucgacaaauga

SEQ ID NO: 203170 - RNA, 1410 nt, Artificial Sequence; identical to SEQ ID NO: 203169
  derived and/or modified sequence opt5 from neuraminidase__InfluenzaA__ADU76314

SEQ ID NO: 203171 - RNA, 1410 nt, Artificial Sequence; identical to SEQ ID NO: 203169
  derived and/or modified sequence opt5 from neuraminidase__InfluenzaA__ADU76315

SEQ ID NO: 203172 - RNA, 1410 nt, Artificial Sequence; identical to SEQ ID NO: 203169
  derived and/or modified sequence opt5 from neuraminidase__InfluenzaA__ADU76316

SEQ ID NO: 203173 - RNA, 1410 nt, Artificial Sequence
  derived and/or modified sequence opt5 from neuraminidase__InfluenzaA__ADU76317
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaccuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 203174 - RNA, 1410 nt, Artificial Sequence
  derived and/or modified sequence opt5 from neuraminidase__InfluenzaA__ADU76318
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucauaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaggacaucgugggcauuaaugaaugguccggguacucuggcagcuucguccaacaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 203175 - RNA, 1410 nt, Artificial Sequence; identical to SEQ ID NO: 201005
  derived and/or modified sequence opt5 from neuraminidase__InfluenzaA__ADU76319

SEQ ID NO: 203176 - RNA, 1410 nt, Artificial Sequence; identical to SEQ ID NO: 199762
  derived and/or modified sequence opt5 from neuraminidase__InfluenzaA__ADU76320

SEQ ID NO: 203177 - RNA, 1410 nt, Artificial Sequence; identical to SEQ ID NO: 199762
  derived and/or modified sequence opt5 from neuraminidase__InfluenzaA__ADU76321

SEQ ID NO: 203178 - RNA, 1410 nt, Artificial Sequence
  derived and/or modified sequence opt5 from neuraminidase__InfluenzaA__ADU76322
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaagucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcaucauuucuuuuuguggagucaauuccgacacagugggcuggagcuggcccgauggggcugagcugccuuucaccaucgacaaguga

SEQ ID NO: 203179 - RNA, 1410 nt, Artificial Sequence; identical to SEQ ID NO: 203168
  derived and/or modified sequence opt5 from neuraminidase__InfluenzaA__ADU76323

SEQ ID NO: 203180 - RNA, 1410 nt, Artificial Sequence; identical to SEQ ID NO: 203169
  derived and/or modified sequence opt5 from neuraminidase__InfluenzaA__ADU76324

SEQ ID NO: 203181 - RNA, 1410 nt, Artificial Sequence; identical to SEQ ID NO: 203168
  derived and/or modified sequence opt5 from neuraminidase__InfluenzaA__ADU76325

SEQ ID NO: 203182 - RNA, 1410 nt, Artificial Sequence; identical to SEQ ID NO: 203169
  derived and/or modified sequence opt5 from neuraminidase__InfluenzaA__ADU76326

SEQ ID NO: 203183 - RNA, 1410 nt, Artificial Sequence; identical to SEQ ID NO: 203169
  derived and/or modified sequence opt5 from neuraminidase__InfluenzaA__ADU76327

SEQ ID NO: 203184 - RNA, 1410 nt, Artificial Sequence; identical to SEQ ID NO: 203168
  derived and/or modified sequence opt5 from neuraminidase__InfluenzaA__ADU76328

SEQ ID NO: 203185 - RNA, 1410 nt, Artificial Sequence; identical to SEQ ID NO: 203169
  derived and/or modified sequence opt5 from neuraminidase__InfluenzaA__ADU76329

SEQ ID NO: 203186 - RNA, 1410 nt, Artificial Sequence; identical to SEQ ID NO: 203169
  derived and/or modified sequence opt5 from neuraminidase__InfluenzaA__ADU76330

SEQ ID NO: 203187 - RNA, 1410 nt, Artificial Sequence; identical to SEQ ID NO: 203169
  derived and/or modified sequence opt5 from neuraminidase__InfluenzaA__ADU76331

SEQ ID NO: 203188 - RNA, 1410 nt, Artificial Sequence; identical to SEQ ID NO: 203169
  derived and/or modified sequence opt5 from neuraminidase__InfluenzaA__ADU76332

SEQ ID NO: 203189 - RNA, 1410 nt, Artificial Sequence; identical to SEQ ID NO: 199762
  derived and/or modified sequence opt5 from neuraminidase__InfluenzaA__ADU76333

SEQ ID NO: 203190 - RNA, 1410 nt, Artificial Sequence; identical to SEQ ID NO: 199762
  derived and/or modified sequence opt5 from neuraminidase__InfluenzaA__ADU76334

SEQ ID NO: 203191 - RNA, 1410 nt, Artificial Sequence; identical to SEQ ID NO: 199762
  derived and/or modified sequence opt5 from neuraminidase__InfluenzaA__ADU76335

SEQ ID NO: 203192 - RNA, 1410 nt, Artificial Sequence; identical to SEQ ID NO: 203169
  derived and/or modified sequence opt5 from neuraminidase__InfluenzaA__ADU76336

SEQ ID NO: 203193 - RNA, 1410 nt, Artificial Sequence; identical to SEQ ID NO: 200529
  derived and/or modified sequence opt5 from neuraminidase__InfluenzaA__ADU76337

SEQ ID NO: 203194 - RNA, 1410 nt, Artificial Sequence; identical to SEQ ID NO: 201664
  derived and/or modified sequence opt5 from neuraminidase__InfluenzaA__ADU76338

SEQ ID NO: 203195 - RNA, 1410 nt, Artificial Sequence; identical to SEQ ID NO: 203168
  derived and/or modified sequence opt5 from neuraminidase__InfluenzaA__ADU76339

SEQ ID NO: 203196 - RNA, 1410 nt, Artificial Sequence; identical to SEQ ID NO: 199762
  derived and/or modified sequence opt5 from neuraminidase__InfluenzaA__ADU76341

SEQ ID NO: 203197 - RNA, 1410 nt, Artificial Sequence; identical to SEQ ID NO: 199762
  derived and/or modified sequence opt5 from neuraminidase__InfluenzaA__ADU76342

SEQ ID NO: 203198 - RNA, 1410 nt, Artificial Sequence; identical to SEQ ID NO: 199762
  derived and/or modified sequence opt5 from neuraminidase__InfluenzaA__ADU76343

SEQ ID NO: 203199 - RNA, 1410 nt, Artificial Sequence; identical to SEQ ID NO: 203169
  derived and/or modified sequence opt5 from neuraminidase__InfluenzaA__ADU76344

SEQ ID NO: 203200 - RNA, 1410 nt, Artificial Sequence; identical to SEQ ID NO: 203169
  derived and/or modified sequence opt5 from neuraminidase__InfluenzaA__ADU76345

SEQ ID NO: 203201 - RNA, 1410 nt, Artificial Sequence
  derived and/or modified sequence opt5 from neuraminidase__InfluenzaA__ADU76346
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccgaaaccgacaauaacuuuagcaucaagcaagacaucgugggaauuaaugagugguccggcuacucugggagcuucguccagcaucccgaacuuacaggccuggauuguauccgcccuugcuucuggguggagcucauuagaggacggcccaaagagaacacgaucuggaccuccggcagcucuauuuccuuuugugggguuaauagcgacacagugggauggucuuggcccgauggcgcugaacugccuuucaccaucgacaaguga

SEQ ID NO: 203202 - RNA, 1410 nt, Artificial Sequence; identical to SEQ ID NO: 200529
  derived and/or modified sequence opt5 from neuraminidase__InfluenzaA__ADU76347

SEQ ID NO: 203203 - RNA, 1410 nt, Artificial Sequence
  derived and/or modified sequence opt5 from neuraminidase__InfluenzaA__ADV17285
augaaccccaaucaggagaucauuaccaucggcagcgugugcaugacaauugggauggccaaccugauccuccaaauuggaaauaucaucuccauuuggaucucucacagcauucagcugggcaaccagaaucagaucgaaacguguaaccaauccgucauuaccuacgagaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaagggagauguguuugucauucgggaaccguucaucagcuguucuccccucgagugccgcaccuuuuuccugacacagggcgcccuucugaaugacaaacauuccaacggcaccauuaaggauagaagcccuuaucggacgcucaugucuugucccaucggggaagugccuucccccuacaacagccgcuuugaguccguugccuggucugcuagcgccugccacgacggaauuaauuggcugaccaucggcaucuccgggccugauaacggagcuguggccguccugaaauauaauggcauuaucacagacaccauuaagagcuggagaaacaauauccuccggacacaagagucugaaugugcgugcgugaacggguccuguuucaccgugaugacggauggaccgagcgacggccaggccucuuacaagauuuuucgcaucgagaaaggcaagaucgucaaaagcguugaaaugaaugcucccaacuaucauuacgaggagugcuccuguuacccugauucuagcgaaauuacaugcgugugcagagacaauuggcacggguccaaccggcccugggugagcuucaaucagaaccuggaguaucagaucggauacauuuguucuggcaucuuuggggauaauccucgccccaacgacaagaccggauccugcggcccggucagcucuaauggggccaacggagugaaaggcuucuccuuuagauauggcaacgggguuuggauuggacggacaaagagcaucuccucucgcaauggcuucgaaaugauuugggauccuaacggguggaccggaaccgacaauaacuuuagcaucaagcaagacaucgugggcauuaaugagugguccggguacucuggcagcuucguccagcaucccgaacuuacaggacuggauuguaucagaccuugcuucuggguggagcucauucggggccgccccaaagagaacacgaucuggaccuccgggagcucuauuuccuuuuguggaguuaauagcgacacagugggcuggucuuggcccgauggggcugaacugccuuucaccaucgacaaguga

SEQ ID NO: 203204 - RNA, 1410 nt, Artificial Sequence; identical to SEQ ID NO: 199762
  derived and/or modified sequence opt5 from neuraminidase__InfluenzaA__ADV17295

SEQ ID NO: 203205 - RNA, 1410 nt, Artificial Sequence
  derived and/or modified sequence opt5 from neuraminidase__InfluenzaA__ADV17305
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuucccucgaaugccgcaccuuuuuccugacacagggcgcccuucugaaugacaagcauagcaacggcaccauuaaagauagaucucccuaucggacgcucauguccuguccuaucggggaggugcccagcccuuacaacucccgcuuugaaucuguugccuggagcgcuuccgccugccacgacggaauuaauuggcugaccaucggcaucagcgggucugauaacggagcuguggccguccugaaguauaauggcauuaucacagacaccauuaaguccuggagaaacaauauccuccggacacaagagagcgagugugcgugcgugaacgggucuuguuucaccauuaugacggauggacccagcgacggccaggccuccuacaaaaucuuucgcaucgaaaagggcaaaauugugaagucugucgagaugaaugcuccuaacuaucauuacgaagagugcagcuguuacccggauuccagcgagaucacaugcguuugcagagacaauuggcacgggucuaaccggcccuggguguccuucaaucagaaccuggaauaucagauuggauacaucuguagcggcauuuuuggggauaauccucgccccaacgacaaaaccggaucuugcggcccuguguccagcaauggggccaacggagucaagggcuucuccuuuaaguauggcaacgggguguggaucggaagaacaaaaucuauuagcucccggaauggcuucgagaugaucugggaucccaacggguggaccggaaccgacaauaacuuuucuaucaagcaagacauuguuggcaucaaugaauggagcggguacuccggcagcuucgugcagcauccggagcuuacaggacuggauuguauucgcccuugcuucugggucgaacucaucagaggccggcccaaagagaacacgauuuggaccucuggguccagcaucucuuuuuguggaguuaauuccgacacagugggcuggagcuggccugauggggcugagcugcccuucaccaucgacaaguga

SEQ ID NO: 203206 - RNA, 1410 nt, Artificial Sequence; identical to SEQ ID NO: 199762
  derived and/or modified sequence opt5 from neuraminidase__InfluenzaA__ADV17315

SEQ ID NO: 203207 - RNA, 1410 nt, Artificial Sequence; identical to SEQ ID NO: 201193
  derived and/or modified sequence opt5 from neuraminidase__InfluenzaA__ADV17325

SEQ ID NO: 203208 - RNA, 1410 nt, Artificial Sequence
  derived and/or modified sequence opt5 from neuraminidase__InfluenzaA__ADV17335
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcgucuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagugcccuuucaccauugacaaguga

SEQ ID NO: 203209 - RNA, 1410 nt, Artificial Sequence; identical to SEQ ID NO: 199762
  derived and/or modified sequence opt5 from neuraminidase__InfluenzaA__ADV19022

SEQ ID NO: 203210 - RNA, 1410 nt, Artificial Sequence
  derived and/or modified sequence opt5 from neuraminidase__InfluenzaA__ADV41679
augaaccccaaucagaagaucauuaccaucggcagcgugugcaugacaauugggauggccaaccugauccuccaaauuggaaauaucaucuccauuuggaucucucacagcauucagcugagaaaccagaaucagaucgagacguguaaccaauccgucauuaccuacgaaaauaacacauggguuaaucagaccuaugugaacaucucuaauacaaacuucgcugccggccagagcguggucuccgugaaacuugcgggaaauucuagccugugcccuguuuccgggugggcuauuuacagcaaggacaacucuauccggaucggcuccaaaggggauguguuugucauucgcgagccguucaucagcuguucuccccucgaaugcagaaccuuuuuccugacacagggagcccuucugaaugacaagcauuccaacggcaccauuaaagaucggagcccuuaucgcacgcucaugucuugucccaucggcgaggugccuucccccuacaacagcagauuugaauccguugccuggucugcuagcgccugccacgacgggauuaauuggcugaccaucggaaucuccggcccugauaacggggcuguggccguccugaaguauaauggaauuaucacagacaccauuaagagcuggcggaacaauauccuccgcacacaagagucugagugugcgugcgugaacggcuccuguuucaccgugaugacggaugggccgagcgacggacaggccucuuacaaaauuuuuagaaucgaaaagggcaaaaucgucaagagcguugagaugaaugcucccaacuaucauuacgaagagugcuccuguuacccugauucuagcgagauuacaugcgugugccgggacaauuggcacggcuccaaccgccccugggugagcuucaaucagaaccuggaauaucagaucggguacauuuguucuggaaucuuuggcgauaauccuagacccaacgacaaaaccggguccugcggaccggucagcucuaauggcgccaacggggugaagggauucuccuuuaaguauggcaacggcguuuggauugggcggacaaaaagcaucuccucucgcaauggauucgagaugauuugggauccuaacggcuggaccgggaccgacaauaacuuuagcaucaagcaagacaucgugggaauuaaugaaugguccggcuacucugggagcuucguccagcaucccgagcuuacaggccuggauuguaucagaccuugcuucuggguggaacucauucggggacgccccaaagagaacacgaucuggaccuccggcagcucuauuuccuuuugugggguuaauagcgacacagugggauggucuuggcccgauggcgcugagcugccuuucaccaucgacaaguga

SEQ ID NO: 203211 - RNA, 1410 nt, Artificial Sequence
  derived and/or modified sequence opt5 from neuraminidase__InfluenzaA__ADV76582
augaaccccaaucagaagaucauuaccaucggcagcgugucccugacaauuucuacggucugcuucuuuaugcaaaucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccagcagcuccugucaugacggaaaggccuggcugcacguuugcauuacaggcgaugacaagaacgcuaccgccagcuucaucuacaauggccggcuuguggauucugucguguccuggagcaaagagauucugcgcacccaggaaucugagugugugugcaucaacgggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuauccuagauaccccggcguccggugugugugccgcgacaacuggaaggggagcaauagaccuauuguugauaucaacauuaaagaccacucuaucguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccauuaaugagacaagcagacucggcuaugagaccuuuaaggucaucgaaggguggucuaacccuaaauccaagcugcagaucaaucgccaggugauugucgacaaaggaaaccggagcggcuacucuggcaucuucuccguggaggggaagucuuguauuaauagaugcuuuuauguugaacugauccggggaagaaaggaggaaaccgaggugcucuggacauccaacucuauugucguguucuguggcaccagcgggacauacggaacgggcuccuggcccgauggggcugaccugaaucuuaugccuaucuga

SEQ ID NO: 203212 - RNA, 1410 nt, Artificial Sequence; identical to SEQ ID NO: 199623
  derived and/or modified sequence opt5 from neuraminidase__InfluenzaA__ADV76590

SEQ ID NO: 203213 - RNA, 1410 nt, Artificial Sequence; identical to SEQ ID NO: 199623
  derived and/or modified sequence opt5 from neuraminidase__InfluenzaA__ADV76601

SEQ ID NO: 203214 - RNA, 1410 nt, Artificial Sequence; identical to SEQ ID NO: 200616
  derived and/or modified sequence opt5 from neuraminidase__InfluenzaA__ADV76612

SEQ ID NO: 203215 - RNA, 1410 nt, Artificial Sequence; identical to SEQ ID NO: 199623
  derived and/or modified sequence opt5 from neuraminidase__InfluenzaA__ADV76623

SEQ ID NO: 203216 - RNA, 1410 nt, Artificial Sequence; identical to SEQ ID NO: 199623
  derived and/or modified sequence opt5 from neuraminidase__InfluenzaA__ADV76634

SEQ ID NO: 203217 - RNA, 1410 nt, Artificial Sequence; identical to SEQ ID NO: 202490
  derived and/or modified sequence opt5 from neuraminidase__InfluenzaA__ADV76645

SEQ ID NO: 203218 - RNA, 1410 nt, Artificial Sequence
  derived and/or modified sequence opt5 from neuraminidase__InfluenzaA__ADV76667
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggacgggcggauacacggauucuguuuaucgaggagggcaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaaaagccgcaacccgaauaacgagagaggaaaucagggcgucaaggggugggcuuucgacaacggagaugacguguggaugggccggaccauuuccagagaucuucgcagcggguaugaaacauuuaagguuaucggaggcuggucuaccccuaauuccaaaagccaaauuaacagacaggugaucgucgacucugauaauagauccggcuacagcgggauuuucuccguggagggaaagucuuguaucaaccgcugcuuuuaugucgagcugauucggggcagaaaacaggaaacacgcgugugguggaccagcaauuccaucguuguguucugugggacgucuggaacauacggcaccgggagcuggcccgacggcgccaacaucaauuuuaugccuauuuga

SEQ ID NO: 203219 - RNA, 1410 nt, Artificial Sequence; identical to SEQ ID NO: 202492
  derived and/or modified sequence opt5 from neuraminidase__InfluenzaA__ADV76676

SEQ ID NO: 203220 - RNA, 1410 nt, Artificial Sequence; identical to SEQ ID NO: 201633
  derived and/or modified sequence opt5 from neuraminidase__InfluenzaA__ADV76697

SEQ ID NO: 203221 - RNA, 1410 nt, Artificial Sequence
  derived and/or modified sequence opt5 from neuraminidase__InfluenzaA__ADV76708
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacaucacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugaacugggcgugcccuuucaccucgggaccaagcaggucuguauugccugguccucuagcuccugccaugacggaaaagccuggcugcacguguguaucacaggcgaugacaagaacgcuaccgccagcuucauuuauaauggccggcuuguugauucuguggucuccuggagcaaagagauccugcgcacccaggaaucugagugcguguguauuaacgggacaugcacgguggucaugaccgacggauccgcuagcggcaaggccgauacaaaaauccucuuuaucgaggaagggaagauuguucauaccuccacacugucuggaagcgcgcaacacguggaggaaugcuccuguuacccuagauaucccggcgugcggugcgucugucgcgacaacuggaaggggagcaauagaccuaucguggauauuaacaucaaagaccacucuauuguuuccagcuacgugugcucuggacuugucggcgacacgccccggaagaaugauagcuccucuagcucccauugucuggacccgaacaaugaggaaggcgggcacggagugaaaggcugggccuucgaugacgggaacgauguuuggaugggacgcaccaucagcgagaagucuagacucggcuacgagacauuuaaagugaucgaagggugguccaauccuaagagcaaacugcagauuaaccggcaggucaucguggaccgcggaaauagaucuggcuauuccggcauuuucagcgucgaggggaaguccugcaucaaccgguguuuuuacguggaacugauuagaggacgcaaggaggaaaccgagguucucuggaccucuaauagcaucguggucuucugcggcacauccgggaccuauggaacaggcucuuggcccgauggggcugacauuaaccugaugccuaucuga

SEQ ID NO: 203222 - RNA, 1410 nt, Artificial Sequence
  derived and/or modified sequence opt5 from neuraminidase__InfluenzaA__ADV76719
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuaagcucgcugaguacagaaauugguccaaaccccagugugacauuaccggguucgccccuuuuucuaaggauaacagcauccggcuguccgcgggaggcgacaucugggugacacgcgagcccuaugucucuugcgauccugacaaguguuaccaauucgcucuugggcagggaaccacacugaauaacgugcauagcaauaacaccguuagagaucggacgccguaucgcacacuccugaugaaugaacugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggcagacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaaaucucgccucggcuaugagacauuuaaggugaucgaagggugguccaauccuaaaagcaagcugcagaugaacagacaggucauuguggaccggggaaaucgcucuggcuacuccggcaucuucagcgucgaggggaaguccuguauuaacagaugcuuuuauguggaacugauccggggaagaaaagaggaaaccgagguucucuggaccucuaauagcauuguggucuucuguggcacauccgggaccuacggaacaggcucuuggcccgauggggcugacaucaaccugaugccuauuuga

SEQ ID NO: 203223 - RNA, 1410 nt, Artificial Sequence
  derived and/or modified sequence opt5 from neuraminidase__InfluenzaA__ADV76730
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagacccugcgcacacaggaaucugagugugugugcaucaacgggacguguaccguggucaugacagacggauccgcuagcggcaaggccgauaccaaaauucucuuuaucgaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaaggaugacagcuccucuagcucccauugccuggauccgaauaacgaggaaggcgggcacggagugaaaggcugggccuucgacgaugggaaugacguuuggaugggacgcacaauuagcgagaagucuagacucggcuaugagaccuuuaaagugaucgaagggugguccaacccuaagagcaaacugcagaucaaucggcaggucauuguggaucgcggaaacagaucuggcuacuccggcaucuucagcgucgaggggaaguccuguauuaaucggugcuuuuauguggaacugaucagaggacgcaaggaggaaaccgagguucucuggacaucuaacagcauuguggucuucuguggcaccuccgggacauacggaacgggcucuuggcccgacggggcugauaucaaucugaugccuauuuga

SEQ ID NO: 203224 - RNA, 1410 nt, Artificial Sequence
  derived and/or modified sequence opt5 from neuraminidase__InfluenzaA__ADV78132
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggcuuaaccagaccuauguuaauaucagcaacacaaauuucgcugccgggcaguccguggugucugucaaacuggcgggaaacagcucccucugcccugugagcggcugggcuauuuacucuaaggacaauuccaucagaaucgggagcaaaggagauguuuuugugauucgggagccguucaucucuuguucccccagcgaaugccgcaccuuuuuccugacacagggcgcccuucugaacgacaagcauucuaauggcaccauuaaagauagauccccuuaucggacgcucaugagcugucccaucggggaggucccuucccccuacaacucucgcuuugaaagcguggccugguccgcuagcgccugccacgacggaauuaacuggcugaccaucggcaucucugggccugauaauggagcuguugccgugcugaaguauaacggcauuaucacagacaccauuaaguccuggagaaauaacauccuccggacacaagagagcgagugugcgugcgucaaugggucuuguuucaccauuaugacggauggaccgagcgacggccaggccuccuacaaaaucuuucgcaucgaaaagggcaaaauugugaagucuguggggaugaacgcucccaauuaucauuacgaggaaugcagcuguuacccugauuccagcgagaucacaugcgucugcagagacaacuggcacggaucuaaucggcccuggguuuccuucaaccagaaucuggaguaucagauuggcuacaucuguagcgggauuuuuggagauaacccucgccccaaugacaaaaccggcucuugcgggccgguguccagcaacggagccaauggcgugaagggcuucuccuuuaaguaugggaacggagucuggaucggcagaacaaaaucuauuagcucccggaagggguucgaaaugaucugggauccuaacggauggaccggcaccgacaauaacuuuucuaucaaacaagacauuguggggaucaaugaguggagcggcuacuccggcagcuucguucagcaucccgaacuuacaggacuggauuguauucgcccuugcuucuggguggagcucaucagagggcggcccaaggaaaacacgauuugggcuucuggauccagcaucucuuuuuguggcgucaauuccgacaccgugggguggagcuggcccgauggagccgagcugccuuucaucauugacaaauga

SEQ ID NO: 203225 - RNA, 1413 nt, Artificial Sequence
  derived and/or modified sequence opt5 from neuraminidase__InfluenzaA__ADW09104
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccaauaacaaggcugccucuuacaaaaucuucaagauugaaaagggaaaagugacaaagagcaucgagcugaaugcuccuaacuuuuauuacgaagaguguuccugcuacccggacaccggcauugucaugugugugugccgggauaauuggcaugggucuaaccgccccugggugagcuucaaucagaaccuugacuaucaaaucggauacauuugcuccggcgucuuuggggauaauccuagacccgaggacggagaaggcagcuguaacccuguuaccguggauggcgccaauggggugaaaggauucucuuauaaguacggcaacggggucuggaucggacggacaaaauccaaucgccugagaaagggcuuugagaugauuugggaccccaacggguggacgaacaccgacagcgauuucucugugaaacaggacguuguggcgaucacagauugguccggcuauagcggauccuuuguccagcacccggaacucaccggccuggacugcauccggccuuguuucuggguggagcuuguucgcgggcugcccagagaaaauacaaccauuuggacgucuggaagcuccaucucuuucugcggcgugaacagcgauacagccaauugguccuggccugacggggcugagcuccccuuuaccauugauaaguga

SEQ ID NO: 203226 - RNA, 1413 nt, Artificial Sequence; identical to SEQ ID NO: 200485
  derived and/or modified sequence opt5 from neuraminidase__InfluenzaA__ADW09114

SEQ ID NO: 203227 - RNA, 1413 nt, Artificial Sequence
  derived and/or modified sequence opt5 from neuraminidase__InfluenzaA__ADW09123
augaaccccaaucagaagaucauuaccaucggcagcauuuccaucgccauugggaucacaucucugaugcuccaaaucggaaacauuaucagcauuugggcuucccacucuauccagacgggcagccagaauaacaccgggauuugcaaucagagaaucauuacauacgagaacuccaccugggugaaucauacauaugucaacaucaauaacaccaauguuguggccggagaagacaaaacaucugugacccuggcgggcaacagcucccuuuguagcaucucugggugggcuauuuacacgaaggauaauuccauccggauuggaagcaaaggcgacgucuucgugauccgcgagccuuuuauuucuugcucccaccuggaauguagaaccuucuuucucacacaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcaugggguggcugacaaucggaaucagcggcccugacaacggggcggucgccgugcugaaguauaauggaauuaucaccggcacgauuaaaucuuggaagaaacagauccucagaacacaggaguccgagugcguuuguaugaacggcagcugcuuuaccauuaugacagaugggcccucuaauaaggcugccagcuacaaaaucuucaagaucgaaaagggaaaagugaccaaguccauugagcugaacgcuccuaauuuuuauuacgaagaguguucuugcuacccggacaccggcaucgucaugugugugugccgggauaacuggcaugggagcaaucgccccuggguguccuucaaccagaaucuugacuaucaaauuggauacaucugcagcggcgucuuuggggauaacccuagacccgaggacggagaaggcucuuguaauccuguuacaguggauggcgccgacggggugaaaggauucuccuauaaguacggcaacggggucuggauuggacggacgaaaagcaaucgccugagaaagggcuuugagaugaucugggaccccaacggguggaccaauacagauucugacuucuccgugaaacaggauguuguggcgauuaccgacuggagcggcuauuccggaucuuuuguccagcacccggaacucacaggccuggauugcauccggccuuguuucuggguggagcuuguucgcgggcugcccagagaaaacaccacgaucuggacaagcggauccucuauuagcuucugcggcgugaacuccgacaccgccaauuggagcuggccugauggggcugagcuccccuuuaccaucgacaaguga

SEQ ID NO: 203228 - RNA, 1413 nt, Artificial Sequence
  derived and/or modified sequence opt5 from neuraminidase__InfluenzaA__ADW09156
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccgacggggugaaaggauucuccuauaaguacggcaacggggucuggaucggacggacaaaaagcaaucgccugagaaagggcuuugagaugauuugggaccccaacggguggacgaauaccgauucugacuucuccgugaaacaggauguuguggcgaucacagacuggagcggcuauuccggaucuuuuguccagcacccggaacucaccggccuggauugcauccggccuuguuucuggguggagcuuguucgcgggcugcccagagaaaacacaaccauuuggacgagcggauccucuaucagcuucugcggcgugaacuccgacacagccaauuggagcuggccugauggggcugagcuccccuuuaccauugacaaguga

SEQ ID NO: 203229 - RNA, 1413 nt, Artificial Sequence
  derived and/or modified sequence opt5 from neuraminidase__InfluenzaA__ADW09167
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccgugaacggcgccgauggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcauccggccuuguuucuggguggagcuuguucgcgggcugcccagagaaaacacaaccauuuggacgagcggauccucuaucagcuucugcggcgucaauuccgauacagccaacuggagcuggccugacggggcugagcuccccuuuaccauugauaaguga

SEQ ID NO: 203230 - RNA, 1413 nt, Artificial Sequence; identical to SEQ ID NO: 200485
  derived and/or modified sequence opt5 from neuraminidase__InfluenzaA__ADW09178

SEQ ID NO: 203231 - RNA, 1413 nt, Artificial Sequence; identical to SEQ ID NO: 200485
  derived and/or modified sequence opt5 from neuraminidase__InfluenzaA__ADW09189

SEQ ID NO: 203232 - RNA, 1413 nt, Artificial Sequence; identical to SEQ ID NO: 203229
  derived and/or modified sequence opt5 from neuraminidase__InfluenzaA__ADW09211

SEQ ID NO: 203233 - RNA, 1413 nt, Artificial Sequence
  derived and/or modified sequence opt5 from neuraminidase__InfluenzaA__ADW09222
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauuccguuaccguggauggcgccgacggggugaaaggauucagcuauaaguacggcaacggggucuggaucggacggacaaaaucuaaucgccugagaaagggcuuugagaugauuugggacccuaacggguggacgaauaccgauuccgacuucagcgugaaacaggauguuguggcgaucacagacugguccggcuauucuggcagcuuuguccagcaccccgaacucaccggacuggauugcauccggccguguuucuggguggagcuuguucgcgggcugccuagagaaaacacaaccauuuggacguccggaucuagcaucuccuucugcggcgugaacagcgacacagccaauuggucuuggcccgauggggcugagcucccuuuuaccauugacaaguga

SEQ ID NO: 203234 - RNA, 1413 nt, Artificial Sequence
  derived and/or modified sequence opt5 from neuraminidase__InfluenzaA__ADW09233
augaaccccaaucagaagaucauuaccaucggcagcauuuccaucgccauugggacaaucucucugaugcuccaaaucggaaacauuaucagcauuugggcuucccacucuauccagacgggcagccagaauaacaccgggauuugcaaucagagaaucauuacauacgagaacuccaccugggugaaucauacauaugugaacaucaauaacaccaauguuguggccggagaagacaaaacaucugugacccuggcgggcaacagcucccuuuguagcaucucugggugggcuauuuacacgaaggauaauuccauccggauuggaagcaaaggcgacgucuucgugauccgcgagccuuuuauuucuugcucccaccuggaauguagaaccuucuuucucacacaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcaugggguggcugacaaucggaaucagcggcccugacaacggggcggucgccgugcugaaguauaauggaauuaucaccggcacgauuaaaucuuggaagaaacagauccucagaacacaggaguccgagugcguuuguaugaacggcagcugcuuuaccauuaugacagaugggcccucuaauaaggcugccagcuacaaaaucuucaagaucgaaaagggaaaagugaccaaguccauugagcugaacgcuccuaauuuuuauuacgaagaguguucuugcuacccggacaccggcaucgucaugugugugugccgggauaacuggcaugggagcaaucgccccuggguguccuucaaccagaaucuugacuaucaaauuggauacaucugcagcggcgucuuuggggauaacccuagacccgaggacggagaaggcucuuguaauccuguuacaguggauggcgccaacggggugaaaggauucuccuauaaguacggcaauggggucuggauuggacggacgaaaagcaaccgccugagaaagggcuuugagaugaucugggaccccaauggguggaccaacacagacucugauuucuccgugaaacaggacguuguggcgauuaccgauuggagcggcuauuccggaucuuuuguccagcacccggaacucacaggccuggacugcauccggccuuguuucuggguggagcuuguucgcgggcugcccagagaaaacaccacgaucuggacaagcggauccucuauuagcuucugcggcgucaauuccgauaccgccaacuggagcuggccugacggggcugagcuccccuuuaccaucgauaaguga

SEQ ID NO: 203235 - RNA, 1413 nt, Artificial Sequence; identical to SEQ ID NO: 203228
  derived and/or modified sequence opt5 from neuraminidase__InfluenzaA__ADW09244

SEQ ID NO: 203236 - RNA, 1413 nt, Artificial Sequence; identical to SEQ ID NO: 203228
  derived and/or modified sequence opt5 from neuraminidase__InfluenzaA__ADW09255

SEQ ID NO: 203237 - RNA, 1413 nt, Artificial Sequence; identical to SEQ ID NO: 203228
  derived and/or modified sequence opt5 from neuraminidase__InfluenzaA__ADW09266

SEQ ID NO: 203238 - RNA, 1413 nt, Artificial Sequence; identical to SEQ ID NO: 203228
  derived and/or modified sequence opt5 from neuraminidase__InfluenzaA__ADW09277

SEQ ID NO: 203239 - RNA, 1413 nt, Artificial Sequence; identical to SEQ ID NO: 200485
  derived and/or modified sequence opt5 from neuraminidase__InfluenzaA__ADW09288

SEQ ID NO: 203240 - RNA, 1413 nt, Artificial Sequence; identical to SEQ ID NO: 203229
  derived and/or modified sequence opt5 from neuraminidase__InfluenzaA__ADW09299

SEQ ID NO: 203241 - RNA, 1413 nt, Artificial Sequence; identical to SEQ ID NO: 200485
  derived and/or modified sequence opt5 from neuraminidase__InfluenzaA__ADW09310

SEQ ID NO: 203242 - RNA, 1413 nt, Artificial Sequence; identical to SEQ ID NO: 200485
  derived and/or modified sequence opt5 from neuraminidase__InfluenzaA__ADW09330

SEQ ID NO: 203243 - RNA, 1413 nt, Artificial Sequence; identical to SEQ ID NO: 203228
  derived and/or modified sequence opt5 from neuraminidase__InfluenzaA__ADW10475

SEQ ID NO: 203244 - RNA, 1413 nt, Artificial Sequence; identical to SEQ ID NO: 203229
  derived and/or modified sequence opt5 from neuraminidase__InfluenzaA__ADW10486

SEQ ID NO: 203245 - RNA, 1413 nt, Artificial Sequence; identical to SEQ ID NO: 200485
  derived and/or modified sequence opt5 from neuraminidase__InfluenzaA__ADW10497

SEQ ID NO: 203246 - RNA, 1413 nt, Artificial Sequence
  derived and/or modified sequence opt5 from neuraminidase__InfluenzaA__ADW10508
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugguuaacgauaagcauagcaaugggacagugaaagaccggucuccguaucgcgcccuuauguccugcccccugggagaggcuccuagccccuacaacuccaaguucgaaucugucgccuggagcgcuuccgccugucacgauggcaugggguggcucaccaucggaauuagcggcccugacaacggggcgguggccguucugaaguauaauggaaucauuacaggcaccaucaaaucuuggaagaaacagauucugagaacgcaggaguccgagugcguguguaugaacggcagcugcuuuacaaucaugaccgaugggcccucuaauaaggcugccagcuacaaaaucuucaagauugaaaagggaaaagucacaaaguccaucgagcucaacgcuccuaauuuuuauuacgaagaguguucuugcuacccggacaccggcauugugaugugugugugccgggauaacuggcaugggagcaaucgccccugggucuccuucaaccagaaucuggacuaucaaaucggauacauuugcagcggcguuuuuggggauaacccuagacccgaggacggagaaggcucuuguaauccugugaccgugaacggcgccgauggggucaaaggauucuccuauaaguacggcaaugggguguggaucggacggacaaaaagcaaccgccuuagaaagggcuuugagaugauuugggaccccaauggguggacgaacaccgacucugauuucuccguuaaacaggacguggucgcgaucacagauuggagcggcuauuccggaucuuuugugcagcacccggaacugaccggccucgacugcauccggccuuguuucuggguugagcuggugcgcgggcuucccagagaaaacacaaccauuuggacgagcggauccucuaucagcuucugcggcgucaauuccgauacagccaacuggagcuggccugacggggcugagcugcccuuuaccauugauaaguga

SEQ ID NO: 203247 - RNA, 1413 nt, Artificial Sequence; identical to SEQ ID NO: 200485
  derived and/or modified sequence opt5 from neuraminidase__InfluenzaA__ADW10519

SEQ ID NO: 203248 - RNA, 1413 nt, Artificial Sequence; identical to SEQ ID NO: 200485
  derived and/or modified sequence opt5 from neuraminidase__InfluenzaA__ADW10530

SEQ ID NO: 203249 - RNA, 1413 nt, Artificial Sequence
  derived and/or modified sequence opt5 from neuraminidase__InfluenzaA__ADW10541
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguauggauggcagcugcuuuacaaucaugaccgacgggcccucuaacaaggcugccagcuacaaaaucuucaagauugaaaagggaaaagugacaaaguccaucgagcugaaugcuccuaacuuuuauuacgaagaguguucuugcuacccggauaccggcauugucaugugugugugccgggacaauuggcaugggagcaaccgccccuggguguccuucaaucagaaccuugauuaucaaaucggauacauuugcagcggcgucuuuggggacaauccuagacccgaggauggagaaggcucuuguaacccuguuaccguggacggcgccaauggggugaaaggauucuccuauaaguacggcaacggggucuggaucggacggacaaaaagcaaucgccugagaaagggcuuugagaugauuugggaccccaacggguggacgaauaccgauucugacuucuccgugaaacaggauguuguggcgaucacagacuggagcggcuauuccggaucuuuuguccagcacccggaacucaccggccuggauugcauccggccuuguuucuggguggagcuuguucgcgggcugcccagagaaaacacaaccauuuggacgagcggauccucuaucagcuucugcggcgugaacuccgacacagccaauuggagcuggccugauggggcugagcuccccuuuaccauugacaaguga

SEQ ID NO: 203250 - RNA, 1413 nt, Artificial Sequence
  derived and/or modified sequence opt5 from neuraminidase__InfluenzaA__ADW10552
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccugacuuuuauuacgaagaguguucuugcuacccggauaccggcauugucaugugugugugccgggacaauuggcaugggagcaaccgccccuggguguccuucaaucagaaccuugauuaucaaaucggauacauuugcagcggcgucuuuggggacaauccuagacccgaggauggagaaggcucuuguaacccuguuaccgugaauggcgccgacggggugaaaggauucuccuauaaguacggcaacggggucuggaucggacggacaaaaagcaaucgccugagaaagggcuuugagaugauuugggaccccaacggguggacgaauaccgauucugacuucuccgugaaacaggauguuguggcgaucacagacuggagcggcuauuccggaucuuuuguccagcacccggaacucaccggccuggauugcauccggccuuguuucuggguggagcuuguucgcgggcugcccagagaaaacacaaccauuuggacgagcggauccucuaucagcuucugcggcgugaacuccgacacagccaauuggagcuggccugauggggcugagcuccccuuuaccauugacaaguga

SEQ ID NO: 203251 - RNA, 1413 nt, Artificial Sequence; identical to SEQ ID NO: 202961
  derived and/or modified sequence opt5 from neuraminidase__InfluenzaA__ADW10563

SEQ ID NO: 203252 - RNA, 1413 nt, Artificial Sequence; identical to SEQ ID NO: 200485
  derived and/or modified sequence opt5 from neuraminidase__InfluenzaA__ADW10574

SEQ ID NO: 203253 - RNA, 1413 nt, Artificial Sequence
  derived and/or modified sequence opt5 from neuraminidase__InfluenzaA__ADW10585
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaagagcgugacccuggcgggcaauuccagccuuuguucuauuuccgggugggcuaucuacacaaaagauaacagcauucggaucggaucuaagggcgacgucuucgugauucgcgagccuuuuaucuccugcagccaccuggaauguagaaccuucuuucucacgcaaggcgcccugcuuaaugauaaacauucuaacgggaccguuaaggaccgguccccguaucgcgcccugaugagcugcccccucggagaggcuccuucccccuacaauucuaaguucgaaagcguggccugguccgcuagcgccugucacgauggcaugggguggcugacaaucggaauuucuggcccugacaacggggcggucgccgugcugaaauauaacggaaucauuaccggcacaaucaaguccuggaaaaagcagauucucagaacccaggagagcgagugcguuuguaugaauggcucuugcuuuacgaucaugacagaugggcccagcaacaaagcugccuccuacaagaucuucaagauugaaaaaggaaaggugaccaaaucuaucgagcugaaugcuccuaacuuuuauuacgaagaguguagcugcuacccggacacaggcauugucaugugugugugccgggauaauuggcauggguccaaccgccccugggugagcuucaaucagaaccuugaguaucaaaucggauacauuugcucuggcgucuuuggggacaauccuagacccgaagauggagagggcuccuguaacccuguuaccguggacggcgccaauggggugaagggauucagcuauaaauacggcaacggggucuggaucggacggaccaagucuaaucgccugagaaaaggcuuugaaaugauuugggaucccaacggguggacaaauacggacuccgacuucagcgugaagcaggauguuguggcgaucaccgacugguccggcuauucuggaucuuuuguccagcacccggagcucacaggccuggauugcauccggccuuguuucuggguggaacuuguucgcgggcugcccagagagaacaccacaauuuggaccuccggaucuagcaucuccuucugcggcgugaacagcgacacggccaauuggucuuggccugauggggcugagcuccccuuuacaauugacaaguga

SEQ ID NO: 203254 - RNA, 1413 nt, Artificial Sequence; identical to SEQ ID NO: 203229
  derived and/or modified sequence opt5 from neuraminidase__InfluenzaA__ADW10596

SEQ ID NO: 203255 - RNA, 1413 nt, Artificial Sequence; identical to SEQ ID NO: 203228
  derived and/or modified sequence opt5 from neuraminidase__InfluenzaA__ADW10607

SEQ ID NO: 203256 - RNA, 1413 nt, Artificial Sequence; identical to SEQ ID NO: 203228
  derived and/or modified sequence opt5 from neuraminidase__InfluenzaA__ADW10618

SEQ ID NO: 203257 - RNA, 1413 nt, Artificial Sequence; identical to SEQ ID NO: 203228
  derived and/or modified sequence opt5 from neuraminidase__InfluenzaA__ADW10629

SEQ ID NO: 203258 - RNA, 1413 nt, Artificial Sequence; identical to SEQ ID NO: 203228
  derived and/or modified sequence opt5 from neuraminidase__InfluenzaA__ADW10724

SEQ ID NO: 203259 - RNA, 1413 nt, Artificial Sequence; identical to SEQ ID NO: 203229
  derived and/or modified sequence opt5 from neuraminidase__InfluenzaA__ADW10735

SEQ ID NO: 203260 - RNA, 1413 nt, Artificial Sequence; identical to SEQ ID NO: 203229
  derived and/or modified sequence opt5 from neuraminidase__InfluenzaA__ADW10746

SEQ ID NO: 203261 - RNA, 1413 nt, Artificial Sequence
  derived and/or modified sequence opt5 from neuraminidase__InfluenzaA__ADW10757
augaaccccaaucagaagaucauuaccaucggcagcauuuccaucgccauugggaucaucucucugaugcuccaaauuggaaacaucauuagcaucugggcuucccacucuauucagacaagaagccagaauaacacgggcaucugcaaucagcggauuaucaccuacgagaacuccacaugggugaaucauaccuaugugaacaucaauaacacaaauguuguggccgggggagacaaaaccucugugacacuggcgggcaacagcucccuuuguagcauuucugggugggcuaucuacaccaaggauaauuccauucgcaucggaagcaaaggcgacgucuucgugauuagagaaccuuuuaucucuugcucccaccuggagugucggacguucuuucucacccaaggcgcccugcuuaacgauaagcauagcaaugggacaguuaaagaccgcucuccguauagagcccugauguccugcccccucggagaagcuccuagccccuacaacuccaaguucgagucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucuccggacgcaggaauccgagugcguuuguaugaacggcagcugcuuuacacugaugaccgaugggcccucuaauaaggcugccagcuacaaaaucuucaagaucgagaagggaaaagugacaaaguccauugaacuuaacgcuccuaauuuuuauuacgaggaauguucuugcuacccggacaccggcaucgucaugugugugugccgcgauaacuggcaugggagcaauagacccuggguguccuucaaccagaaucuggacuaucaaauuggauacaucugcagcggcgucuuuggggauaacccucggcccgaggacggagagggcucuuguaauccuguuaccguggauggcgccaacggggugaaaggauucuccuauaaguacggcaauggggucuggauuggacgcacaaaaagcaacagacuccggaagggcuuugaaaugaucugggaccccaauggguggacgaacaccgacucugauuucuccgugaaacaggacguuguggcgauuacagauuggagcggcuauuccggaucuuuuguccagcacccggagcugaccggccuugacugcauccgcccuuguuucuggguggaacugguuagagggcucccccgggagaacacaaccaucuggacgagcggauccucuauuagcuucugcggcgucaauuccgauacagccaacuggagcuggccugacggggcugaacugcccuuuaccaucgauaaguga

SEQ ID NO: 203262 - RNA, 1413 nt, Artificial Sequence; identical to SEQ ID NO: 203228
  derived and/or modified sequence opt5 from neuraminidase__InfluenzaA__ADW10768

SEQ ID NO: 203263 - RNA, 1413 nt, Artificial Sequence; identical to SEQ ID NO: 200485
  derived and/or modified sequence opt5 from neuraminidase__InfluenzaA__ADW10779

SEQ ID NO: 203264 - RNA, 1413 nt, Artificial Sequence
  derived and/or modified sequence opt5 from neuraminidase__InfluenzaA__ADW10790
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcaucauuccuuguuucuggguggagcuuguucgggggcugccccgcgaaaacgccacaaucuggaccagcggauccucuauuagcuucugcggcgucaauuccgauacggcuaacuggagcuggccugacggggccgagcuccccuuuacaaucgauaaguga

SEQ ID NO: 203265 - RNA, 1413 nt, Artificial Sequence; identical to SEQ ID NO: 201954
  derived and/or modified sequence opt5 from neuraminidase__InfluenzaA__ADW10801

SEQ ID NO: 203266 - RNA, 1413 nt, Artificial Sequence; identical to SEQ ID NO: 203228
  derived and/or modified sequence opt5 from neuraminidase__InfluenzaA__ADW10812

SEQ ID NO: 203267 - RNA, 1413 nt, Artificial Sequence; identical to SEQ ID NO: 202980
  derived and/or modified sequence opt5 from neuraminidase__InfluenzaA__ADW10823

SEQ ID NO: 203268 - RNA, 1413 nt, Artificial Sequence
  derived and/or modified sequence opt5 from neuraminidase__InfluenzaA__ADW10834
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugaucaaguccauugagcugaacgcuccuaauuuuuauuacgaagaguguucuugcuacccggacacaggcaucgucaugugugugugccgggauaacuggcaugggagcaaucgccccuggguguccuucaaccagaaucuugacuaucaaauuggauacaucugcagcggcgucuuuggggauaacccuagacccgaggacggagaaggcucuuguaauccuguuaccguggauggcgccaacggggugaaaggauucuccuauaaguacggcaauggggucuggauuggacggaccaaaagcaaccgccugagaaagggcuuugagaugaucugggaccccaauggguggacaaacacggacucugauuucuccgugaaacaggacguuguggcgaucaccgauuggagcggcuauuccggaucuuuuguccagcacccggaacucacaggccuggacugcauucggccuuguuucuggguggagcuuguucgcgggcugcccagagaaaacaccacaaucuggaccagcggauccucuauuagcuucugcggcgucaauuccgauacggccaacuggagcuggccugacggggcugagcuccccuuuacaaucgauaaguga

SEQ ID NO: 203269 - RNA, 1413 nt, Artificial Sequence; identical to SEQ ID NO: 203229
  derived and/or modified sequence opt5 from neuraminidase__InfluenzaA__ADW10845

SEQ ID NO: 203270 - RNA, 1413 nt, Artificial Sequence
  derived and/or modified sequence opt5 from neuraminidase__InfluenzaA__ADW10856
augaaccccaaucagagaaucauuaccaucggcagcauuuccaucgccauugggaucaucucucugaugcuccaaauuggaaacaucauuagcaucugggcuucccacucuauucagacaggcagccagaauaacacggggaucugcaaucagcggauuaucaccuacgagaacuccacaugggugaaucauaccuaugugaacaucaauaacacaaauguuguggccggagaagacaagaccucuaugacacuggcgggcaacagcucccuuuguagcauuucugggugggcuaucuacaccaaagauaauuccauucgcaucggaagcaagggcgacguguucgucauuagagagccuuuuaucucuugcucccaccuggaaugucggacguucuuucucacccaaggcgcccugcuuaacgauaaacauagcaaugggacagccaaggaccgcucuccguauagagcucugauguccugcccccucggagaggccccuagccccuacaacuccaaauucgaaucuguggcuuggagcgccuccgcgugucacgauggcaugggguggcugaccaucggaauuagcggcccugacaacggggccguugcugugcugaaguauaauggaaucauuacaggcaccaucaagucuuggaaaaagcagauucuccggacgcaggaguccgagugcgucuguaugaacggcagcugcuuuacaaucaugaccgaugggcccucuaauaaagccgcuagcuacaagaucuucaaaauugaaaagggaaaggugacaaaauccaucgagcugaacgccccuaauuuuuauuacgaagaguguucuugcuacccggacaccggcauuguuaugugugugugccgcgauaacuggcaugggagcaauagacccugggucuccuucaaccagaaucuugacuaucaaaucggauacauuugcagcggcguguuuggggauaacccucggcccgaggacggagaaggcucuuguaauccugugaccgucgauggcgcgaacgggguuaagggauucuccuauaaauacggcaaugggguguggaucggacgcacaaagagcaacagacugcggaaaggcuuugagaugauuugggaccccaauggguggacgaacaccgacucugauuucuccgugaagcaggacgucguggccaucacagauuggagcggcuauuccggaucuuuuguucagcacccggaacucaccggccuggacugcauccgcccuuguuucuggguggagcuugucagagggcugccccgggaaaacacaaccauuuggacgagcggauccucuaucagcuucugcggcgucaauuccgauacagcuaacuggagcuggccugacggggccgagcuccccuuuaccauugauaaauga

SEQ ID NO: 203271 - RNA, 1413 nt, Artificial Sequence; identical to SEQ ID NO: 203228
  derived and/or modified sequence opt5 from neuraminidase__InfluenzaA__ADW10867

SEQ ID NO: 203272 - RNA, 1413 nt, Artificial Sequence; identical to SEQ ID NO: 203228
  derived and/or modified sequence opt5 from neuraminidase__InfluenzaA__ADW10878

SEQ ID NO: 203273 - RNA, 1413 nt, Artificial Sequence; identical to SEQ ID NO: 203228
  derived and/or modified sequence opt5 from neuraminidase__InfluenzaA__ADW10889

SEQ ID NO: 203274 - RNA, 1413 nt, Artificial Sequence; identical to SEQ ID NO: 200485
  derived and/or modified sequence opt5 from neuraminidase__InfluenzaA__ADW10900

SEQ ID NO: 203275 - RNA, 1410 nt, Artificial Sequence; identical to SEQ ID NO: 201508
  derived and/or modified sequence opt5 from neuraminidase__InfluenzaA__ADW11155

SEQ ID NO: 203276 - RNA, 1410 nt, Artificial Sequence; identical to SEQ ID NO: 199762
  derived and/or modified sequence opt5 from neuraminidase__InfluenzaA__ADW23530

SEQ ID NO: 203277 - RNA, 1410 nt, Artificial Sequence
  derived and/or modified sequence opt5 from neuraminidase__InfluenzaA__ADW54483
augaaccccaaucagaagaucauuaccaucggcagcgugugcaugacaauugggauggccaaccugaugcuccaaaucggaaauauuaucuccaucuggauuucucacagcauccagcugggcaaccagucccagauugagacguguaaucaaucugucaucaccuacgaaaacaauacauggguuaaccagaccuaugugaauauuagcaacacaaauuucgcugccgggcaguccguggucucugugaaacuugcgggaaacagcucccugugcccuguuagcggcugggcuaucuacucuaaggacaauuccauuagaaucgggagcaaaggagauguguuugucauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggugccuagccccuacaacucccgcuuugaaucuguugccuggagcgcuuccgccugccacgacggaaucaacuggcugaccauuggcaucagcgggccugauaauggagcuguggccguccugaaguauaacggcaucauuacagacaccaucaagucuuggagaaauaacauucuccggacacaagaguccgagugugcgugcgugaaugggagcuguuucaccaucaugacggauggaccgucugacggccaggccagcuacaaaauuuuucgcaucgaaaagggcaaaaucgugaaguccgucgagaugaacgcucccaauuaucauuacgaagagugcucuuguuacccugauagcuccgagauuacaugcguuugcagagacaacuggcacgggagcaaucggcccugggugucuuucaaccagaaucuggaauaucagaucggauacauuuguuccggcaucuuuggggauaacccucgccccaaugacaaaaccggaagcugcggcccggugucuuccaacggggccaauggagucaagggcuucagcuuuaaguauggcaacgggguguggauuggaagaacaaaauccaucucuagccggaagggcuucgagaugauuugggauccuaacggguggaccggaaccgacaauaacuuuuccaucaaacaagacaucguuggcauuaaugaauggucuggguacagcggcuccuucgugcagcaucccgagcuuacaggacuggauuguauccgcccuugcuucugggucgaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 203278 - RNA, 1410 nt, Artificial Sequence
  derived and/or modified sequence opt5 from neuraminidase__InfluenzaA__ADW54494
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucauuggcaucaaugaaugguccggguacucuggcagcuucgugcaacaucccgagcuuacaggacuggauuguauuagaccuugcuucugggucgaacucauccggggccgccccaaagagaacacgauuuggaccuccgggagcucuaucuccuuuuguggagugaauagcgacacaguuggcuggucuuggcccgauggggcugagcugccuuucaccaucgacaaguga

SEQ ID NO: 203279 - RNA, 1410 nt, Artificial Sequence
  derived and/or modified sequence opt5 from neuraminidase__InfluenzaA__ADW54514
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggaaaaacaauauccucagaacacaagagucugagugugcgugcgugaacggguccuguuucaccgugaugacggauggaccgagcgacggccaggccucuuacaagauuuuucggaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucggaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgagaugauuugggauccuaacggguggaccggaaccgacaauaacuuuagcaaaaagcaggacaucaucggcauuaaugaaugguccggguacucuggcagcuucgugcaacaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggcugagcugccuuucaccaucgacaaguga

SEQ ID NO: 203280 - RNA, 1410 nt, Artificial Sequence
  derived and/or modified sequence opt5 from neuraminidase__InfluenzaA__ADW54522
augaaccccaaucagaagaucauuaccaucggcagcgugugcaugauuaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaaucggcuccgcacccaagagucugagugugcgugcgugaacggguccuguuucacagugaugaccgauggaccgagcgacggccaggccucuuacaaaauuuuuagaaucgaaaagggcaaaaucgucaagagcguugagaugaaugcucccaacuaucauuacgaagagugcuccuguuacccugauucuagcgagauuacgugcgugugccgggacaauuggcacggguccaaccgccccugggugagcuucaaucagaaccuggaauaucagaucggauacauuuguucuggcaucuuuggggauaauccuagacccaacgacaaaacaggauccugcggcccggucagcucuaauggggccaacggagugaagggcuucuccuuuaaguauggcaacgggguuuggauuggacggaccaaaagcaucuccucucgcaagggcuucgagaugauuugggauccuaauggguggacaggaaccgacaacaauuuuagcaucaaacaagacaucgugggcauuaacgaaugguccggguacucuggcagcuucguccagcaucccgagcuuaccggacuggauuguaucagaccuugcuucuggguggaacucauucggggccgccccaaggagaauacaaucuggacguccgggagcucuauuuccuuuuguggaguuaacagcgacaccgugggcuggucuuggcccgauggggcugagcugccuuucacaaucgacaaauga

SEQ ID NO: 203281 - RNA, 1410 nt, Artificial Sequence
  derived and/or modified sequence opt5 from neuraminidase__InfluenzaA__ADW65826
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggaguuaauucugacacagugggcugguccuggcccgauggggcugagcugccuuucaccaucgacaaauga

SEQ ID NO: 203282 - RNA, 1410 nt, Artificial Sequence; identical to SEQ ID NO: 199623
  derived and/or modified sequence opt5 from neuraminidase__InfluenzaA__ADW80519

SEQ ID NO: 203283 - RNA, 1410 nt, Artificial Sequence; identical to SEQ ID NO: 199623
  derived and/or modified sequence opt5 from neuraminidase__InfluenzaA__ADW82127

SEQ ID NO: 203284 - RNA, 1410 nt, Artificial Sequence; identical to SEQ ID NO: 199623
  derived and/or modified sequence opt5 from neuraminidase__InfluenzaA__ADW82138

SEQ ID NO: 203285 - RNA, 1410 nt, Artificial Sequence; identical to SEQ ID NO: 199623
  derived and/or modified sequence opt5 from neuraminidase__InfluenzaA__ADW82149

SEQ ID NO: 203286 - RNA, 1410 nt, Artificial Sequence; identical to SEQ ID NO: 199623
  derived and/or modified sequence opt5 from neuraminidase__InfluenzaA__ADW82158

SEQ ID NO: 203287 - RNA, 1410 nt, Artificial Sequence; identical to SEQ ID NO: 199623
  derived and/or modified sequence opt5 from neuraminidase__InfluenzaA__ADW82169

SEQ ID NO: 203288 - RNA, 1410 nt, Artificial Sequence; identical to SEQ ID NO: 199623
  derived and/or modified sequence opt5 from neuraminidase__InfluenzaA__ADW82180

SEQ ID NO: 203289 - RNA, 1410 nt, Artificial Sequence; identical to SEQ ID NO: 199762
  derived and/or modified sequence opt5 from neuraminidase__InfluenzaA__ADW82191

SEQ ID NO: 203290 - RNA, 1410 nt, Artificial Sequence; identical to SEQ ID NO: 199762
  derived and/or modified sequence opt5 from neuraminidase__InfluenzaA__ADW82201

SEQ ID NO: 203291 - RNA, 1410 nt, Artificial Sequence; identical to SEQ ID NO: 199762
  derived and/or modified sequence opt5 from neuraminidase__InfluenzaA__ADW82211

SEQ ID NO: 203292 - RNA, 1410 nt, Artificial Sequence; identical to SEQ ID NO: 199762
  derived and/or modified sequence opt5 from neuraminidase__InfluenzaA__ADW82221

SEQ ID NO: 203293 - RNA, 1410 nt, Artificial Sequence; identical to SEQ ID NO: 199762
  derived and/or modified sequence opt5 from neuraminidase__InfluenzaA__ADW82231

SEQ ID NO: 203294 - RNA, 1410 nt, Artificial Sequence; identical to SEQ ID NO: 199762
  derived and/or modified sequence opt5 from neuraminidase__InfluenzaA__ADW82241

SEQ ID NO: 203295 - RNA, 1410 nt, Artificial Sequence; identical to SEQ ID NO: 199762
  derived and/or modified sequence opt5 from neuraminidase__InfluenzaA__ADW82251

SEQ ID NO: 203296 - RNA, 1410 nt, Artificial Sequence; identical to SEQ ID NO: 199762
  derived and/or modified sequence opt5 from neuraminidase__InfluenzaA__ADW82261

SEQ ID NO: 203297 - RNA, 1410 nt, Artificial Sequence; identical to SEQ ID NO: 199762
  derived and/or modified sequence opt5 from neuraminidase__InfluenzaA__ADW82271

SEQ ID NO: 203298 - RNA, 1410 nt, Artificial Sequence; identical to SEQ ID NO: 203281
  derived and/or modified sequence opt5 from neuraminidase__InfluenzaA__ADW95306

SEQ ID NO: 203299 - RNA, 1410 nt, Artificial Sequence; identical to SEQ ID NO: 203281
  derived and/or modified sequence opt5 from neuraminidase__InfluenzaA__ADW95313

SEQ ID NO: 203300 - RNA, 1410 nt, Artificial Sequence; identical to SEQ ID NO: 203281
  derived and/or modified sequence opt5 from neuraminidase__InfluenzaA__ADW95320

SEQ ID NO: 203301 - RNA, 1410 nt, Artificial Sequence; identical to SEQ ID NO: 203281
  derived and/or modified sequence opt5 from neuraminidase__InfluenzaA__ADW95327

SEQ ID NO: 203302 - RNA, 1410 nt, Artificial Sequence
  derived and/or modified sequence opt5 from neuraminidase__InfluenzaA__ADW95333
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggauccgcuaaaucuauuagcuccagaaaggccuucgagaugaucugggauccuaacggcuggacagggaccgacaauaacuuuucuaucaaacaauacauuguuggaaucaaugaauggagcggcuauuccgggagcuucguggagcaucccgaacuuaccggccuggacuguauucggccuugcuucugggucgagcucauccgcggaagacccaaggagaacacaauuuggacgucuggcuccagcaucucuuuuugugggguuaauuccgauaccgugggauggagcuggcccgacggcgcggaacugccuuucacaaucgauaaauga

SEQ ID NO: 203303 - RNA, 1410 nt, Artificial Sequence
  derived and/or modified sequence opt5 from neuraminidase__InfluenzaA__ADX20813
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaacugguugccugguccgcuucugccugccacgacggaauuaauuggcugaccaucggcaucagcgggccugauaacggagcuguggccguccucaaguauaauggcauuaucacagacaccauuaaguccuggagaaacaauauccugcggacacaagagagcgagugugcgugcgugaacgggucuuguuucaccgugaugacggauggaccguccgacggccagacaagcuacaaaauuuuucgcaucgaaaagggcaaaaucgucaagucuguugagaugaaugcccccaacuauuacuacgaagagugcagcuguuauccugauuccucugagauuaccugcgugugcagagacaauuggcaugggagcaaccggcccuggguguccuucaaucagaaccuugaauaccagaucggauauauuuguagcggcaucuuuggggauaauccucgccccaacgacaaaacaggaucuugcggcccggucuccagcaauggggcuaacggagugaagggcuucucuuuuaaguacggcaacgggguuuggauuggaagaaccaaauccaucagcucccggaagggcuucgagaugauuugggauccuaauggguggaccggaacagacaacaauuuuucuaucaaacaagacaucgugggcauuaacgaauggagcggguauuccggcucuuucguccagcaccccgagcugacgggacucgauuguauccgcccuugcuucuggguggaacugauuagaggccggcccaaggagaauaccaucuggacaagcggguccagcauuucuuuuuguggaguuaacuccgacaccgugggcuggagcuggcccgauggggccgagcuuccuuucacaaucgacaaauga

SEQ ID NO: 203304 - RNA, 1410 nt, Artificial Sequence
  derived and/or modified sequence opt5 from neuraminidase__InfluenzaA__ADX20814
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuauuacuacgaagagugcucuuguuauccugauagcuccgagaucacaugcguuugcagagacaacuggcaugggagcaaucggcccugggugucuuucaaccagaaucuggaauaccagauuggauauaucuguuccggcauuuuuggggauaacccucgccccaaugacaaaaccggaagcugcggcccggugucuuccaacggggccaauggagucaagggcuucagcuuuaaguacggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguauagcggcuccuucgugcagcaccccgagcuuacaggacuggauuguauucgcccuugcuucugggucgaacucaucagaggccggcccaaggagaacacgauuuggaccagcgggucuuccaucagcuuuuguggaguuaauucugacacagugggcugguccuggcccgauggggcugagcugccuuucaccaucgacaaauga

SEQ ID NO: 203305 - RNA, 1410 nt, Artificial Sequence; identical to SEQ ID NO: 199623
  derived and/or modified sequence opt5 from neuraminidase__InfluenzaA__ADX21091

SEQ ID NO: 203306 - RNA, 1410 nt, Artificial Sequence; identical to SEQ ID NO: 199762
  derived and/or modified sequence opt5 from neuraminidase__InfluenzaA__ADX21101

SEQ ID NO: 203307 - RNA, 1410 nt, Artificial Sequence; identical to SEQ ID NO: 200629
  derived and/or modified sequence opt5 from neuraminidase__InfluenzaA__ADX36112

SEQ ID NO: 203308 - RNA, 1410 nt, Artificial Sequence
  derived and/or modified sequence opt5 from neuraminidase__InfluenzaA__ADX87386
augaaccccaaucagagaaucauuaccaucggcagcgugucccugacaauuucuacgaucugcuucuuuaugcaaauugccauccucaucaccacagucacccugcacuucaagcaguacgaguuuaacagcccuccgaauaaccagguuaugcuuugugaacccacaauuaucgagcggaauauuaccgaaaucguguaucugacaaacaccacgauugagaaagaaaucugcccuaagcucgcugaguaccgcaauugguccaaaccccagugugacauuaccggguucgccccuuuuucuaaggauaacagcaucagacuguccgcgggaggcgacaucugggugacacgggagcccuaugucucuugcgauccugacaaauguuaccaauucgcucuugggcagggaaccacacugaauaacgugcauagcaauaacaccguucgcgauagaacgccguaucggacacuccugaugaaugaacugggcgugcccuuucaccucgggaccaagcaggucugcauugccugguccucuagcuccugucaugacggaaaggccuggcugcacgugugcaucacaggcgaugacaaaaacgcuaccgccagcuucauuuacaauggccgccuuguugauucuguggucuccuggagcaaggagauccugagaacccaggaaucugagugugugugcauuaacgggacauguacgguggucaugaccgacggauccgcuagcggcaaagccgauacaaagauccucuuuaucgaggaagggaaaauuguucauaccuccacacugucuggaagcgcgcaacacguggaggaaugcuccugcuauccucgguaccccggcgugcgcugugucugcagagacaacuggaaggggagcaaucggccuaucguggauauuaacaucaaggaccacucuauuguuuccagcuacguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucagcgagaaaucucggcucggcuaugagacauuuaaggugaucgaagggugguccaauccuaaaagcaagcugcagauuaaccgccaggucaucguggacagaggaaaucggucuggcuacuccggcauuuucagcgucgaggggaaauccuguaucaacagaugcuuuuauguggaacugauucgcggacggaaggaggaaaccgagguucucuggaccucuaauagcaucguggucuucuguggcacauccgggaccuacggaacaggcucuuggcccgauggggcugacauuaaccugaugccuguguga

SEQ ID NO: 203309 - RNA, 1410 nt, Artificial Sequence
  derived and/or modified sequence opt5 from neuraminidase__InfluenzaA__ADX96270
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcguggcguccgugaaacuugcuggaaauucuagccugugcccugucuccggcugggccaucuacagcaaggacaacucugugagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggcuaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggccgagcugccuuucaccaucgacaaguga

SEQ ID NO: 203310 - RNA, 1410 nt, Artificial Sequence; identical to SEQ ID NO: 203309
  derived and/or modified sequence opt5 from neuraminidase__InfluenzaA__ADX96280

SEQ ID NO: 203311 - RNA, 1410 nt, Artificial Sequence; identical to SEQ ID NO: 200345
  derived and/or modified sequence opt5 from neuraminidase__InfluenzaA__ADX96290

SEQ ID NO: 203312 - RNA, 1410 nt, Artificial Sequence; identical to SEQ ID NO: 199762
  derived and/or modified sequence opt5 from neuraminidase__InfluenzaA__ADX96300

SEQ ID NO: 203313 - RNA, 1410 nt, Artificial Sequence; identical to SEQ ID NO: 199762
  derived and/or modified sequence opt5 from neuraminidase__InfluenzaA__ADX96310

SEQ ID NO: 203314 - RNA, 1410 nt, Artificial Sequence
  derived and/or modified sequence opt5 from neuraminidase__InfluenzaA__ADX96330
augaaccccaaucagaagaucauuaccaucggcagcgugugcaugacaauugggauggccaaccugauccuccaaauuggaaauggcaucuccaucuggauuucucacagcauccagcuggggaaccagaaucagauugagacguguaaccaauccgucaucaccuacgaaaauaacacauggguuaaucagaccuaugugaacauuucuaauacaaacuucgcugccggacagagcguggucuccgugaaacuugcgggcaauucuagccugugcccuguuuccgggugggcuaucuacagcaaggacaacucuauuagaaucggauccaaaggcgauguguuugucauccgggagccguucauuagcuguucuccccucgaaugccgcaccuuuuuccugacacagggcgcccuucugaaugacaagcauuccaacgggaccaucaaagauagaagcccuuaucggacgcucaugucuugucccauuggagaggugccuucccccuacaacagccgcuuugaauccguugccuggucugcuagcgccugccacgacggcaucaauuggcugaccauugggaucuccggaccugauaacggcgcuguggccguccugaaguauaaugggaucauuacagacaccaucaagagcuggagaaacaauauucuccggacacaagagucugagugugcgugcgugaacggauccuguuucaccgugaugacggauggcccgagcgacggccaggccucuuacaaaaucuuucgcauugaaaaggggaaaaucgucaagagcguugagaugaaugcucccaacuaucauuacgaagagugcuccuguuacccugauucuaaugagaucacaugcgugugcagagacaacuggcacggaagcaaucggcccuggguguccuucaaccagaaucuggaauaucagauuggcuacaucuguagcgggauuuuuggagauaacccucgccccaaugacaaaaccggcucuugcgggccggucuccagcaacggagccaacggcgugaagggcuucucuuuuaaguaugggaauggaguuuggaucggcagaacaaaauccauuagcucccggaacggguucgagaugaucugggauccuaauggauggaccggcaccgacaacaauuuuucuauuaagcaagacaucguggggaucaacgaauggagcggcuacuccggaucuuucguccagcaucccgagcuuacaggccuggauuguauucgcccuugcuucuggguggaacucaucagagggcggcccaaagagaauacgauuuggaccagcggauccagcaucucuuuuuguggcguuaacuccgacacagugggguggagcuggcccgauggagcugagcugccuuucaccauugacaaguga

SEQ ID NO: 203315 - RNA, 1410 nt, Artificial Sequence; identical to SEQ ID NO: 199762
  derived and/or modified sequence opt5 from neuraminidase__InfluenzaA__ADX96339

SEQ ID NO: 203316 - RNA, 1410 nt, Artificial Sequence
  derived and/or modified sequence opt5 from neuraminidase__InfluenzaA__ADX96349
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuaaugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 203317 - RNA, 1410 nt, Artificial Sequence; identical to SEQ ID NO: 199762
  derived and/or modified sequence opt5 from neuraminidase__InfluenzaA__ADX96359

SEQ ID NO: 203318 - RNA, 1410 nt, Artificial Sequence; identical to SEQ ID NO: 199762
  derived and/or modified sequence opt5 from neuraminidase__InfluenzaA__ADX96369

SEQ ID NO: 203319 - RNA, 1410 nt, Artificial Sequence
  derived and/or modified sequence opt5 from neuraminidase__InfluenzaA__ADX96380
augaaccccaaucagaagaucauuaccaucggcagcgugugcaugacaauugggauggccaaccugauccuccaaauuggaaauaucaucuccauuuggccuguccacucuauccagcugggcaaccagaaucagauugagacguguaaccaaagcguuaucaccuacgaaaauaacacaugggugaaucagaccuaugugaacauuuccaauacaaacuucgcugccgggcagucugucgugagcaugaaacuugcgggaaauuccucucugugcccgguuggcgggugggcuaucuacagcaaggacaacuccgugagaauuggaagcaaaggcgaugucuuugugauccgggagcccuucaucucuuguuccccucucgaaugccgcaccuuuuuccugacacagggcgcccuucugaaugacaagcauagcaacgggaccauuaaagauagaucucccuaucggacgcucauguccuguccuaucggagagguucccagcccuuacaacucucgcuuugaauccguggccuggagcgcuuccgccugccacgacggcauuaauuggcugaccaucgggauuucuggaccggauaacggcgcugucgccgugcugaaguauaaugggaucaucacagacaccauuaagagcuggagaaacaauauccuccggacacaagaguccgagugugcgugcgugaacggaagcuguuucaccgucaugacggauggccccucugacggccaggccuccuacaaaauuuuucgcaucgaaaaggggaaaauuguugagagcguggaaaugaaugcuccuaacuaucauuacgaggagugcucuuguuaccccgauagcuccgaaaucacaugcgugugcagagacaauuggcacggaucuaaccggccuugggucagcuucaaucagaaccuggaguaucagaucggcuacauuuguuccgggaucuuuggagauaauccccgcccgaacgacaagaccggcagcugcgggccugugucuuccaauggagccaacggcguuaaaggcuucagcuuuaaguaugggaacggaguguggauuggcagaacaaagucuaucuccagccggaauggguucgaaaugauuugggaucccaacggauggaccggcaccgacaauaacuuuuccaucaaacaagacauugucgggaucaaugaguggucuggcuacagcggauccuucgugcagcauccugaacuuacaggccuggauuguauccgccccugcuucuggguugagcucauuagagggcggcccaaggagaacacgaucuggaccucuggaagcuccauuagcuuuuguggcgucaauucugacacaguggggugguccuggccugauggagcugaacugccguucaccaucgacaaauga

SEQ ID NO: 203320 - RNA, 1410 nt, Artificial Sequence
  derived and/or modified sequence opt5 from neuraminidase__InfluenzaA__ADX96390
augaaccccaaucagaagaucauuaccaucggcagcgugugcaugacaauugggauggccaaccugauccuccaaauuggaaauaucaucuccauuuggcugucucacagcauccagcuuggcaaccagaaucagauugagacguguaaccaauccgucaucaccuacgaaaauaacacauggguuaaucagaccuaugugaacauuucuaauacaaacuucgcugccgggcagagcguggucuccgugaaacuggcgggaaauucuagccucugcccuguuuccggcugggcuaucuacagcaaggacaacucuauuagaaucggguccaaaggagauguguuugucauccgggagccguucauuagcuguucuccccuggaaugccgcaccuuuuuccuuacacagggcgcccugcucaaugacaagcauuccaacggcaccaucaaagauagaagcccuuaucggacgcugaugucuugucccauuggggaggugccuucccccuacaacagccgcuuugaauccguugccuggucugcuagcgccugccacgacggaaucaauuggcugaccauuggcaucuccgggccugauaacggagcuguggccguccucaaguauaauggcaucauuacagacaccaucaagagcuggagaaacaauauucugcggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuugaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcugacaggacucgauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcuuccuuucaccauugacaaguga

SEQ ID NO: 203321 - RNA, 1410 nt, Artificial Sequence; identical to SEQ ID NO: 199762
  derived and/or modified sequence opt5 from neuraminidase__InfluenzaA__ADX96400

SEQ ID NO: 203322 - RNA, 1410 nt, Artificial Sequence; identical to SEQ ID NO: 199762
  derived and/or modified sequence opt5 from neuraminidase__InfluenzaA__ADX96410

SEQ ID NO: 203323 - RNA, 1410 nt, Artificial Sequence; identical to SEQ ID NO: 199762
  derived and/or modified sequence opt5 from neuraminidase__InfluenzaA__ADX96419

SEQ ID NO: 203324 - RNA, 1410 nt, Artificial Sequence
  derived and/or modified sequence opt5 from neuraminidase__InfluenzaA__ADX96429
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuuuaaguauggcaaugggguguggaucggaagaacaaaaagcauuuccucucggaacggcuucgagaugaucugggacccuaauggguggaccggaaccgauaacaauuuuagcauuaagcaagacaucguccgcaucaacgaaugguccggcuacucugggagcuucgugcagcaucccgagcuuacaggccuggacuguauuagaccuugcuucuggguugaacucauccggggacgccccaaagagaauacgauuuggaccuccggcagcucuaucuccuuuuguggggugaacagcgauacagucggauggucuuggcccgacggcgcugagcugccuuucaccauugauaaguga

SEQ ID NO: 203325 - RNA, 1410 nt, Artificial Sequence; identical to SEQ ID NO: 199762
  derived and/or modified sequence opt5 from neuraminidase__InfluenzaA__ADX96449

SEQ ID NO: 203326 - RNA, 1410 nt, Artificial Sequence; identical to SEQ ID NO: 199762
  derived and/or modified sequence opt5 from neuraminidase__InfluenzaA__ADX96469

SEQ ID NO: 203327 - RNA, 1410 nt, Artificial Sequence; identical to SEQ ID NO: 199762
  derived and/or modified sequence opt5 from neuraminidase__InfluenzaA__ADX96489

SEQ ID NO: 203328 - RNA, 1410 nt, Artificial Sequence; identical to SEQ ID NO: 199762
  derived and/or modified sequence opt5 from neuraminidase__InfluenzaA__ADX96499

SEQ ID NO: 203329 - RNA, 1410 nt, Artificial Sequence
  derived and/or modified sequence opt5 from neuraminidase__InfluenzaA__ADX96509
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaauggagauguguuugucauucgggagccguucaucagcuguucuccccucgaaugccgcaccuuuuuccugacacagggcgcccuucugaacgacaaacauuccaacggcaccauuaaggauagaagcccuuaucggacgcucaugucuugucccaucggggaggugccuucccccuacaauagccgcuuugaauccguugccuggucugcuagcgccugccacgacggaauuaacuggcugaccaucggcaucuccgggccugauaauggagcuguggccguccugaaauauaacggcauuaucacagacaccauuaagagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaacggagugaaaggcuucuccuuuaaguauggcaaugggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 203330 - RNA, 1410 nt, Artificial Sequence; identical to SEQ ID NO: 199762
  derived and/or modified sequence opt5 from neuraminidase__InfluenzaA__ADX96519

SEQ ID NO: 203331 - RNA, 1410 nt, Artificial Sequence; identical to SEQ ID NO: 199762
  derived and/or modified sequence opt5 from neuraminidase__InfluenzaA__ADX96529

SEQ ID NO: 203332 - RNA, 1410 nt, Artificial Sequence; identical to SEQ ID NO: 199762
  derived and/or modified sequence opt5 from neuraminidase__InfluenzaA__ADX96539

SEQ ID NO: 203333 - RNA, 1410 nt, Artificial Sequence; identical to SEQ ID NO: 199762
  derived and/or modified sequence opt5 from neuraminidase__InfluenzaA__ADX96549

SEQ ID NO: 203334 - RNA, 1410 nt, Artificial Sequence; identical to SEQ ID NO: 199762
  derived and/or modified sequence opt5 from neuraminidase__InfluenzaA__ADX96559

SEQ ID NO: 203335 - RNA, 1410 nt, Artificial Sequence; identical to SEQ ID NO: 199762
  derived and/or modified sequence opt5 from neuraminidase__InfluenzaA__ADX96569

SEQ ID NO: 203336 - RNA, 1410 nt, Artificial Sequence; identical to SEQ ID NO: 199752
  derived and/or modified sequence opt5 from neuraminidase__InfluenzaA__ADX96579

SEQ ID NO: 203337 - RNA, 1410 nt, Artificial Sequence; identical to SEQ ID NO: 199762
  derived and/or modified sequence opt5 from neuraminidase__InfluenzaA__ADX96589

SEQ ID NO: 203338 - RNA, 1410 nt, Artificial Sequence; identical to SEQ ID NO: 199762
  derived and/or modified sequence opt5 from neuraminidase__InfluenzaA__ADX96599

SEQ ID NO: 203339 - RNA, 1410 nt, Artificial Sequence
  derived and/or modified sequence opt5 from neuraminidase__InfluenzaA__ADX96609
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuggcgggugggcuauuuacuccaaggacaacagcgugagaaucggaucuaaaggcgaugucuuugugauccgggagccguucauuuccuguagcccccucgaaugccgcaccuuuuuccugacacagggcgcccuucugaaugacaagcauucuaacgggaccaucaaagauagauccccuuaucggacgcucaugagcugucccauuggagagguuccuucucccuacaacucccgcuuugaaagcguggccugguccgcuucugccugccacgacggcaucaauuggcugaccauugggaucagcggaccugauaacggcgcugucgccgugcugaaguauaaugggaucauuacagacaccaucaaguccuggagaaacaauauucuccggacacaagagagcgagugugcgugcgugaacggaucuuguuucaccgucaugacggauggcccguccaauggccaggccagcuacaaaaucuuucgcauugaaaaggggaaaaucguuaagucuguggagaugaacgcucccaauuaucauuacgaagagugcagcuguuacccugacuccucugagaucacaugcgugugcagagauaacuggcacggaagcaaucggcccugggucuccuucaaccagaaucuggaauaucagauuggcuacaucuguagcgggauuuuuggagacaacccucgccccaaugauaaaaccggcucuugcgggccgguguccagcaacggagccaacggcguuaagggcuucucuuuuaaguauggggacggaguguggaucggcagaacaaaauccauuagcucccggaauggguucgagaugaucugggauccuaacggauggaccggcaccgacaauaacuuuucuauuaagcaagacaucgucgggaucaaugaauggagcggcuacuccggaucuuucgugcagcaucccgagcuuacaggccuggauuguauucgcccuugcuucuggguugaacucaucagagggcggcccaaagagaacacgauuuggaccagcggauccagcaucucuuuuuguggcgucaauuccgacacagugggguggagcuggcccgauggagcugagcugccuuucaccauugacaaguga

SEQ ID NO: 203340 - RNA, 1410 nt, Artificial Sequence; identical to SEQ ID NO: 199752
  derived and/or modified sequence opt5 from neuraminidase__InfluenzaA__ADX96619

SEQ ID NO: 203341 - RNA, 1410 nt, Artificial Sequence; identical to SEQ ID NO: 199762
  derived and/or modified sequence opt5 from neuraminidase__InfluenzaA__ADX96629

SEQ ID NO: 203342 - RNA, 1410 nt, Artificial Sequence; identical to SEQ ID NO: 199762
  derived and/or modified sequence opt5 from neuraminidase__InfluenzaA__ADX96639

SEQ ID NO: 203343 - RNA, 1410 nt, Artificial Sequence; identical to SEQ ID NO: 199762
  derived and/or modified sequence opt5 from neuraminidase__InfluenzaA__ADX96649

SEQ ID NO: 203344 - RNA, 1410 nt, Artificial Sequence; identical to SEQ ID NO: 199752
  derived and/or modified sequence opt5 from neuraminidase__InfluenzaA__ADX96659

SEQ ID NO: 203345 - RNA, 1410 nt, Artificial Sequence; identical to SEQ ID NO: 199762
  derived and/or modified sequence opt5 from neuraminidase__InfluenzaA__ADX96669

SEQ ID NO: 203346 - RNA, 1410 nt, Artificial Sequence; identical to SEQ ID NO: 199762
  derived and/or modified sequence opt5 from neuraminidase__InfluenzaA__ADX96679

SEQ ID NO: 203347 - RNA, 1410 nt, Artificial Sequence; identical to SEQ ID NO: 199762
  derived and/or modified sequence opt5 from neuraminidase__InfluenzaA__ADX96689

SEQ ID NO: 203348 - RNA, 1410 nt, Artificial Sequence; identical to SEQ ID NO: 199762
  derived and/or modified sequence opt5 from neuraminidase__InfluenzaA__ADX96699

SEQ ID NO: 203349 - RNA, 1410 nt, Artificial Sequence
  derived and/or modified sequence opt5 from neuraminidase__InfluenzaA__ADX96709
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagauuaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacgagaccggauccugcggcccggucagcucuaauggggccaacggagugaaaggcuucuccuuuaaguauggcaacgggguuuggaucggaagaacaaagagcauuuccucucggaauggcuucgaaaugaucugggauccuaacggguggaccggaaccgacaauaacuuuagcaucaaacaagacauugugggcaucaaugagugguccggguacucuggcagcuucguccagcaucccgaacuuacaggacuggauuguauucgcccuugcuucuggguggagcucaucagaggccggcccaaggagaacacgauuuggaccuccgggagcucuaucuccuuuuguggaguuaauagcgacacagugggcuggucuuggcccgauggggcugaacugccuuucaccaucgacaaauga

SEQ ID NO: 203350 - RNA, 1410 nt, Artificial Sequence
  derived and/or modified sequence opt5 from neuraminidase__InfluenzaA__ADX96719
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaauuugcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuucguccagcaucccgagcugacaggacuugauuguauccgcccuugcuuuuggguggaacugauuagaggccggcccaaagaguccacgguuuggaccagcgggucuuccaucagcuucuguggagugaacucugacacagucggcugguccuggcccgauggggcugagcucccuuuuaccauugacaaguga

SEQ ID NO: 203351 - RNA, 1410 nt, Artificial Sequence; identical to SEQ ID NO: 199762
  derived and/or modified sequence opt5 from neuraminidase__InfluenzaA__ADX96729

SEQ ID NO: 203352 - RNA, 1410 nt, Artificial Sequence
  derived and/or modified sequence opt5 from neuraminidase__InfluenzaA__ADX96739
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaagagcgacacagugggcuggucuuggcccgauggggcugagcugccuuucaccaucgacaaauga

SEQ ID NO: 203353 - RNA, 1410 nt, Artificial Sequence; identical to SEQ ID NO: 199762
  derived and/or modified sequence opt5 from neuraminidase__InfluenzaA__ADX96749

SEQ ID NO: 203354 - RNA, 1410 nt, Artificial Sequence; identical to SEQ ID NO: 199762
  derived and/or modified sequence opt5 from neuraminidase__InfluenzaA__ADX96759

SEQ ID NO: 203355 - RNA, 1410 nt, Artificial Sequence; identical to SEQ ID NO: 200736
  derived and/or modified sequence opt5 from neuraminidase__InfluenzaA__ADX96769

SEQ ID NO: 203356 - RNA, 1410 nt, Artificial Sequence; identical to SEQ ID NO: 199762
  derived and/or modified sequence opt5 from neuraminidase__InfluenzaA__ADX96779

SEQ ID NO: 203357 - RNA, 1410 nt, Artificial Sequence
  derived and/or modified sequence opt5 from neuraminidase__InfluenzaA__ADX96789
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucucccuuaaacuggcgggaaauucuagccucugcccuguguccggcugggcuauuuacagcaaggacaacucuaucagaaucggguccaaaggagauguuuuugugauucgggagccguucaucagcuguucuccccuggaaugccgcaccuuuuuccuuacacagggcgcccugcucaaugacaagcauuccaacggcaccauuaaagauagaagcccuuaucggacgcugaugucuugucccaucggggaggucccuucccccuacaacagccgcuuugaauccguggccuggucugcuagcgccugccacgacggaauuaauuggcugaccaucggcaucuccgggccugauaacggagcuguugccgugcucaaguauaauggcauuaucacagacaccauuaagagcuggagaaacaauauccugcggacacaagagucugagugugcgugcgucaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuugaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcugacaggacucgauuguauccgcccuugcuucugggucgaacugauuagaggccggcccaaagagaacacgaucuggaccuccgggagcucuauuuccuuuuguggagugaauagcgacacaguuggcuggucuuggcccgauggggcugagcuuccuuucaccaucgacaaguga

SEQ ID NO: 203358 - RNA, 1410 nt, Artificial Sequence; identical to SEQ ID NO: 199762
  derived and/or modified sequence opt5 from neuraminidase__InfluenzaA__ADX96799

SEQ ID NO: 203359 - RNA, 1410 nt, Artificial Sequence; identical to SEQ ID NO: 199917
  derived and/or modified sequence opt5 from neuraminidase__InfluenzaA__ADX96809

SEQ ID NO: 203360 - RNA, 1410 nt, Artificial Sequence; identical to SEQ ID NO: 199762
  derived and/or modified sequence opt5 from neuraminidase__InfluenzaA__ADX96819

SEQ ID NO: 203361 - RNA, 1410 nt, Artificial Sequence; identical to SEQ ID NO: 200985
  derived and/or modified sequence opt5 from neuraminidase__InfluenzaA__ADX96829

SEQ ID NO: 203362 - RNA, 1410 nt, Artificial Sequence
  derived and/or modified sequence opt5 from neuraminidase__InfluenzaA__ADX96839
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacaaugugagaaucgggucuaaaggagaugucuuugugauccgggagccguucauuuccuguagcccccucgaaugccgcaccuuuuuccugacacagggcgcccuucugaacgacaagcauucuaacggcaccaucaaagauagauccccuuaucggacgcucaugagcugucccauuggggagguuccuucucccuacaauucccgcuuugaaagcguggccugguccgcuucugccugccacgacggaaucaacuggcugaccauuggcaucagcgggccugauaauggagcugucgccgugcugaaguauaacggcaucauuacagacaccaucaaguccuggagaaauaacauucuccggacacaagagagcgagugugcgugcgugaaugggucuuguuucaccgucaugacggauggaccguccgacggccaggccagcuacaaaaucuuucgcauugaaaagggcaaaaucguuaagucuguggagaugaacgcucccaauuaucauuacgaagagugcagcuguuacccugauuccucugagaucacaugcgugugcagagacaacuggcacgggagcaaucggcccugggucuccuucaaccagaaucuggaauaucagauuggauacaucuguagcggcauuuuuggggauaacccucgccccaaugacaaaaccggaucuugcggcccgguguccagcaacggggccaacggaguuaagggcuucucuuuuaaguauggcaaugggguguggaucggaagaacaaaauccauuagcucccggaacggcuucgagaugaucugggauccuaauggguggaccggaaccgacaacaauuuuucuauuaagcaagacaucgucggcaucaacgaauggagcggguacuccggcucuuucgugcagcaucccgagcuuacaggacuggauuguauucgcccuugcuucuggguugaacucaucagaggccggcccaaagagaauacgauuuggaccagcggguccagcaucucuuuuuguggagugaacuccgacacagucggcuggagcuggcccgauggggcugagcugccuuucaccauugacaaguga

SEQ ID NO: 203363 - RNA, 1410 nt, Artificial Sequence; identical to SEQ ID NO: 199762
  derived and/or modified sequence opt5 from neuraminidase__InfluenzaA__ADX96849

SEQ ID NO: 203364 - RNA, 1410 nt, Artificial Sequence; identical to SEQ ID NO: 199762
  derived and/or modified sequence opt5 from neuraminidase__InfluenzaA__ADX96859

SEQ ID NO: 203365 - RNA, 1410 nt, Artificial Sequence; identical to SEQ ID NO: 200985
  derived and/or modified sequence opt5 from neuraminidase__InfluenzaA__ADX96869

SEQ ID NO: 203366 - RNA, 1410 nt, Artificial Sequence; identical to SEQ ID NO: 199762
  derived and/or modified sequence opt5 from neuraminidase__InfluenzaA__ADX96879

SEQ ID NO: 203367 - RNA, 1410 nt, Artificial Sequence; identical to SEQ ID NO: 199762
  derived and/or modified sequence opt5 from neuraminidase__InfluenzaA__ADX96899

SEQ ID NO: 203368 - RNA, 1410 nt, Artificial Sequence
  derived and/or modified sequence opt5 from neuraminidase__InfluenzaA__ADX96909
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacgauauccuccggacacaagagucugagugugcgugcgugaauggguccuguuucaccgugaugacggacggaccgagcgauggccaggccucuuacaaaauuuuucgcaucgaaaagggcaaaaucgucaagagcguugagauuaacgcucccaauuaucauuacgaagagugcuccuguuacccugacucuagcgagaucacaugcgugugcagagauaacuggcacggguccaaucggcccugggugagcuucaaccagaaucuggaauaucagauuggauacaucuguucuggcauuuuuggggacaacccucgccccaaugauaaaaccggauccugcggcccggucagcucuaacggggccaauggagugaagggcuucuccuuuaaguauggcaacgggguuuggaucggaagaacaaaaagcauuaacucccggaauggcuucgagaugaucugggacccuaacggguggaccggaaccgacaauaacuuuucuaucaagcaagauauugugggcaucaaugaauggagcggguacuccggcucuuucguccagcaucccgagcuuacaggacuggacuguauucgcccuugcuucuggguggaacucaucagaggccggcccaaagagaacacgauuuggaccagcggguccagcaucucuuuuuguggaguuaauuccgauacagugggcuggagcuggcccgacggggcugagcugccuuucaccaucgauaaguga

SEQ ID NO: 203369 - RNA, 1410 nt, Artificial Sequence; identical to SEQ ID NO: 199762
  derived and/or modified sequence opt5 from neuraminidase__InfluenzaA__ADX96919

SEQ ID NO: 203370 - RNA, 1410 nt, Artificial Sequence; identical to SEQ ID NO: 199762
  derived and/or modified sequence opt5 from neuraminidase__InfluenzaA__ADX96929

SEQ ID NO: 203371 - RNA, 1410 nt, Artificial Sequence; identical to SEQ ID NO: 199762
  derived and/or modified sequence opt5 from neuraminidase__InfluenzaA__ADX96939

SEQ ID NO: 203372 - RNA, 1410 nt, Artificial Sequence; identical to SEQ ID NO: 200345
  derived and/or modified sequence opt5 from neuraminidase__InfluenzaA__ADX96949

SEQ ID NO: 203373 - RNA, 1410 nt, Artificial Sequence; identical to SEQ ID NO: 199762
  derived and/or modified sequence opt5 from neuraminidase__InfluenzaA__ADX96959

SEQ ID NO: 203374 - RNA, 1410 nt, Artificial Sequence
  derived and/or modified sequence opt5 from neuraminidase__InfluenzaA__ADX96969
augaaccccaaucagaugaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaagggagaugucuuugugauccgggagccguucauuagcuguucuccccucgaaugccgcaccuuuuuccugacacagggcgcccuucugaaugacaaacauuccaacggcaccaucaaggauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaauauaauggcaucauuacagacaccaucaagagcuggagaaacaauauucuccggacacaagagucugagugugcgugcgugaacggguccuguuucaccgucaugacggauggaccgagcaauggccaggccucuuacaagaucuuucgcauugaaaaaggcaagaucguuaaaagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaagaccggauccugcggcccggugagcucuaacggggccaacggaguuaaaggcuucuccuuuaaguauggcaaugggguguggaucggaagaacaaagagcauuuccucucggaacggcuucgagaugaucugggacccuaauggguggaccggaaccgauaacaauuuuagcauuaaacaagacaucgucggcaucaacgaaugguccggguacucuggcagcuucgugcagcaucccgagcuuacaggacuggacuguauucgcccuugcuucuggguugaacucaucagaggccggcccaaggagaauacgauuuggaccuccgggagcucuaucuccuuuuguggagugaacagcgauacagucggcuggucuuggcccgacggggcugagcugccuuucaccauugauaaauga

SEQ ID NO: 203375 - RNA, 1410 nt, Artificial Sequence; identical to SEQ ID NO: 200985
  derived and/or modified sequence opt5 from neuraminidase__InfluenzaA__ADX96979

SEQ ID NO: 203376 - RNA, 1410 nt, Artificial Sequence; identical to SEQ ID NO: 200985
  derived and/or modified sequence opt5 from neuraminidase__InfluenzaA__ADX96989

SEQ ID NO: 203377 - RNA, 1407 nt, Artificial Sequence
  derived and/or modified sequence opt5 from neuraminidase__InfluenzaA__ADX96999
augaaccccaaucagaagaucauuaccaucggcagcgugugcaugacaauugggauggccaaccugauccuccaaauuggaaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaaaggagauguguuugucauucgggagccguucaucagcuguucuccccucgaaugccgcaccuuuuuccugacacagggcgcccuucugaacgacaagcauuccaauggcaccauuaaagauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaagagcuggagaaauaacauccuccggacacaagagucugagugugcgugcgugaauggguccuguuucaccgugaugacggauggaccgagcaacggccaggccucuuacaaaauuuuucgcaucgaaaagggcaaaaucgucaagagcguugagaugaaugcucccaacuaucauuacgaagagugcuccuguuacccugacucuagcgagauuacaugcgugugcagagauaauuggcacggguccaaccggcccugggugagcuucaaucagaaccuggaauaucagaucggauacauuuguucuggcaucuuuggggacaauccucgccccaacgauaaaaccggauccugcggcccggucagcucuaauggggccaacggagugaagggcuucuccuuuaaguauggcaacgggguuuggauuggaagaacaaaaagcaucuccucucggaauggcuucgagaugauuugggacccuaacggguggaccggaaccgauaauaacuuuagcaucaagcaagacaucgugggcauuaaugaaugguccggguacucuggcagcuucguccagcaucccgagcuuacaggacuggacuguauccgcccuugcuucuggguggaacucauuagaggccggcccaaagagaacacgaucuggaccuccgggagcucuauuuccuuuuguggaguuaauagcgauacagugggcuggucuuggcccgacggggcugagcugccuuucaccaucgauaaguga

SEQ ID NO: 203378 - RNA, 1410 nt, Artificial Sequence; identical to SEQ ID NO: 199762
  derived and/or modified sequence opt5 from neuraminidase__InfluenzaA__ADX97009

SEQ ID NO: 203379 - RNA, 1410 nt, Artificial Sequence; identical to SEQ ID NO: 199917
  derived and/or modified sequence opt5 from neuraminidase__InfluenzaA__ADX97020

SEQ ID NO: 203380 - RNA, 1410 nt, Artificial Sequence
  derived and/or modified sequence opt5 from neuraminidase__InfluenzaA__ADX97030
augaaccccaaucagaagaucauuaccaucggcagcgugugcaugauuaucgggauggccaaccugaugcuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggagguuccuucccccuacaacagccgcuuugaauccguggccuggucugcuagcgccugccacgacggaaucaauuggcugacgauuggcaucuccgggccugauaacggagcugucgccgugcugaaguauaauggcaucauuaccgacacaaucaagagcuggagaaacaauauucuccggacccaagagucugagugugcgugcgugaacggguccuguuucacagucaugaccgauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacgugcgugugcagagacaauuggcacggguccaaccggcccugggucagcuucaaucagaaccuggaauaucagauuggauacaucuguucuggcauuuuuggggauaauccucgccccaacgacaaaacaggauccugcggcccggugagcucuaauggggccaacggaguuaagggcuucuccuuuaaguauggcaacgggguguggaucggaagaaccaaaagcauuuccucucggaauggcuucgagaugaucugggauccuaacggguggacaggaaccgacaauaacuuuagcauuaagcaagacaucgucggcaucaaugaaugguccggguacucuggcagcuucgugcagcaucccgagcuuaccggacuggauuguauucgcccuugcuucuggguugaacucaucagaggccggcccaaagagaacacaauuuggacguccgggagcucuaucuccuuuuguggagugaauagcgacaccgucggcuggucuuggcccgauggggcugagcugccuuucacaauugacaaguga

SEQ ID NO: 203381 - RNA, 1410 nt, Artificial Sequence; identical to SEQ ID NO: 201310
  derived and/or modified sequence opt5 from neuraminidase__InfluenzaA__ADX98643

SEQ ID NO: 203382 - RNA, 1410 nt, Artificial Sequence; identical to SEQ ID NO: 199762
  derived and/or modified sequence opt5 from neuraminidase__InfluenzaA__ADX98653

SEQ ID NO: 203383 - RNA, 1410 nt, Artificial Sequence
  derived and/or modified sequence opt5 from neuraminidase__InfluenzaA__ADX98668
augaaccccaaucagaagaucauuaccaucggcagcauuugcaucacaauugggauggccaaccugauccuccaaaucggaaauauuaucuccauuuggaucucucacagcauucagcugggcaaccagaaucagaucgagacguguaaccaauccgugauuaccuacgaaaauaacacaugggucaaucagaccuauguuaacaucucuaauacaaacuucgcugccgggcagagcgugguguccgucaaacuugcgggaaauucuagccugugcccuguguccggcugggcuaucuacagcaaggacaacucuauuagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggccuggucugcuagcgccugccacgacggaaucaauuggcugaccauuggcaucuccgggccugauaacggagcuguugccgugcugaaguauaauggcauuaucacagacaccauuaagagcuggagaaacaauauccuccggacacaagagucugagugugcgugcgucaacggguccuguuucaccgugaugacggauggaccgagcgacggccaggccucuuacaaaaucuuucgcauugaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugaucugggauccuaacggguggaccggaaccgacaauaacuuuagcauuaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuaucuccuuuuguggagugaauagcgacacaguuggcuggucuuggcccgauggggcugagcugccuuucaccauugacaaguga

SEQ ID NO: 203384 - RNA, 1410 nt, Artificial Sequence; identical to SEQ ID NO: 199762
  derived and/or modified sequence opt5 from neuraminidase__InfluenzaA__ADX98678

SEQ ID NO: 203385 - RNA, 1410 nt, Artificial Sequence; identical to SEQ ID NO: 199762
  derived and/or modified sequence opt5 from neuraminidase__InfluenzaA__ADX98698

SEQ ID NO: 203386 - RNA, 1410 nt, Artificial Sequence
  derived and/or modified sequence opt5 from neuraminidase__InfluenzaA__ADX98708
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaucuacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 203387 - RNA, 1410 nt, Artificial Sequence; identical to SEQ ID NO: 199762
  derived and/or modified sequence opt5 from neuraminidase__InfluenzaA__ADX98722

SEQ ID NO: 203388 - RNA, 1410 nt, Artificial Sequence; identical to SEQ ID NO: 199762
  derived and/or modified sequence opt5 from neuraminidase__InfluenzaA__ADX98732

SEQ ID NO: 203389 - RNA, 1410 nt, Artificial Sequence; identical to SEQ ID NO: 199762
  derived and/or modified sequence opt5 from neuraminidase__InfluenzaA__ADX98742

SEQ ID NO: 203390 - RNA, 1410 nt, Artificial Sequence; identical to SEQ ID NO: 201113
  derived and/or modified sequence opt5 from neuraminidase__InfluenzaA__ADX98751

SEQ ID NO: 203391 - RNA, 1410 nt, Artificial Sequence; identical to SEQ ID NO: 199762
  derived and/or modified sequence opt5 from neuraminidase__InfluenzaA__ADX98761

SEQ ID NO: 203392 - RNA, 1410 nt, Artificial Sequence
  derived and/or modified sequence opt5 from neuraminidase__InfluenzaA__ADX98770
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccuggggcagcuucaaucagaaccuggaauaucagaucggauacauuuguucugggaucuuuggagauaauccucgccccaacgacaaaaccggcuccugcgggccggugagcucuaauggagccaacggcgucaagggcuucuccuuuaaguaugggaacggaguguggauuggcagaacaaaaagcaucuccucucggaauggguucgagaugauuugggauccuaacggauggaccggcaccgacaauaacuuuagcaucaagcaagacaucguugggauuaaugaaugguccggcuacucuggcagcuucgugcagcaucccgagcuuacaggacuggauuguauccgcccuugcuucugggucgaacucauuagagggcggcccaaagagaacacgaucuggaccuccggaagcucuauuuccuuuuguggcgugaauagcgacacaguuggguggucuuggcccgauggagcugagcugccuuucaccaucgacaaguga

SEQ ID NO: 203393 - RNA, 1410 nt, Artificial Sequence; identical to SEQ ID NO: 199762
  derived and/or modified sequence opt5 from neuraminidase__InfluenzaA__ADX98780

SEQ ID NO: 203394 - RNA, 1410 nt, Artificial Sequence
  derived and/or modified sequence opt5 from neuraminidase__InfluenzaA__ADX98788
augaaccccaaucagaagaucauuaccaucggcagcgugugcaugacaauugggauggccaaccugguccuccaaaucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaaguuuagcauuaaacaagacaucgucggcaucaacgaaugguccggguacucuggcagcuucgugcagcaucccgagcuuacaggacuggauuguauucgcccuugcuucuggguugaacucaucagaggccggcccaaggagaauacgauuuggaccuccgggagcucuaucuccuuuuguggagugaacagcgacacagucggcuggucuuggcccgauggggcugagcugccuuucaccauugacaaauga

SEQ ID NO: 203395 - RNA, 1410 nt, Artificial Sequence
  derived and/or modified sequence opt5 from neuraminidase__InfluenzaA__ADX98809
augaaccccaaucagaagaucauuaccaucggcagcgugugcaugacaauugggauggccaaccugauccuccaaauuggaaauaucauccugauuuggaucucccacucuauucagcuuggcaaccagaaucagaucgagacguguaaccaaagcgucauuaccuacgaaaauaacacauggguuaaucagaccuaugugaacaucuccaauacaaacuucgcugccgggcagucuguggucagcgugaaacuggcgggaaauuccucucucugcccuguuagcggcugggcuauuuacuccaaggacaacagcaucagaaucgggucuaaaggagauguguuugucauucgggagccguucaucuccuguagcccccuggaaugccgcaccuuuuuccuuacacagggcgcccugcucaaugacaagcauucuaacggcaccauuaaagauagauccccuuaucggacgcugaugagcugucccaucggggaggugccuucucccuacaacucccgcuuugaaagcguugccugguccgcuucugccugccacgacggaauuaauuggcugaccaucggcaucagcgggccugauaacggagcuguggccguccucaaguauaauggcauuaucacagacaccauuaaguccuggagaaacaauauccugcggacacaagagagcgagugugcgugcgugaacgggucuuguuucaccgugaugacggauggaccguccgacggccaggccagcuacaaaauuuuucgcaucgaaaagggcaaaaucgucaagucuguugagaugaaugcucccaacuaucauuacgaagagugcagcuguuacccugauuccucugagauuacaugcgugugcagagacaauuggcacgggagcaaccggcccuggguguccuucaaucagaaccuugaauaucagaucggauacauuuguagcggcaucuuuggggauaauccucgccccaacgacaaaaccggaucuugcggcccggucuccagcaauggggccaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcugacaggacucgauuguauccgcccuugcuucuggguggaacugauuagaggccggcccaaagagaacacgaucuggaccagcggguccagcauuucuuuuuguggaguuaauuccgacacagugggcuggagcuggcccgauggggcugagcuuccuuucaccaucgacaaguga

SEQ ID NO: 203396 - RNA, 1410 nt, Artificial Sequence; identical to SEQ ID NO: 199762
  derived and/or modified sequence opt5 from neuraminidase__InfluenzaA__ADX98821

SEQ ID NO: 203397 - RNA, 1410 nt, Artificial Sequence; identical to SEQ ID NO: 199762
  derived and/or modified sequence opt5 from neuraminidase__InfluenzaA__ADX98846

SEQ ID NO: 203398 - RNA, 1410 nt, Artificial Sequence
  derived and/or modified sequence opt5 from neuraminidase__InfluenzaA__ADX98856
augaaccccaaucagaagaucaugaccauuggcagcgugugcaugacaaucgggauggccaaccugauucuccaaaucggaaauauuaucuccaucuggauuucucacagcauccagcugggcauucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaaaggagauguguuugucauucgggagccguucaucagcuguucuccccucgaaugccgcaccuuuuuccugacacagggcgcccuucugaacgacaagcauuccaauggcaccauuaaagauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaagagcuggagaaauaacauccuccggacacaagagucugagugugcgugcgugaauggguccuguuucaccgugaugacggauggaccgagcgacggccaggccucuuacaaaauuuuucgcaucgaaaagggcaaaaucgucaagagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaaaaccggauccugcggcccggucagcucuaacggggccaauggagugaagggcuucuccuuuaaguauggcaacgggguuuggauuggaagaacaaaaagcaucuccucucggaacggcuucgagaugauuugggauccuaauggguggaccggaaccgacaacaauuuuagcaucaagcaagacaucgugggcauuaacgaaugguccggguacucuggcagcuucguccagcaucccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 203399 - RNA, 1410 nt, Artificial Sequence; identical to SEQ ID NO: 199762
  derived and/or modified sequence opt5 from neuraminidase__InfluenzaA__ADX98863

SEQ ID NO: 203400 - RNA, 1410 nt, Artificial Sequence; identical to SEQ ID NO: 199762
  derived and/or modified sequence opt5 from neuraminidase__InfluenzaA__ADX98873

SEQ ID NO: 203401 - RNA, 1410 nt, Artificial Sequence
  derived and/or modified sequence opt5 from neuraminidase__InfluenzaA__ADX98883
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacguggcugccgggcagagcgucguguccguuaaacuugcgggaaauucuagccugugcccuguguccggcugggcuauuuacagcaaggacaacucuaucagaaucggguccaaaggagaugccuucgucauucgggagccguuuaucagcuguucuccccucgaaugccgcaccuucuuucugacacagggcgcccuucugaaugacaagcauuccaacggcaccauuaaagauagaagcccuuaucggacgcucaugucuugucccaucggggaggugccuucccccuacaacagccgcuucgaauccguugcuuggucugccagcgcuugccacgacggaauuaauuggcugaccaucggcaucuccgggccugauaacggagccguggcgguccugaaguauaauggcauuaucacagacaccauuaagagcuggagaaacaauauccuccggacacaagagucugagugugccugcgugaacggguccuguuuuaccgugaugacggauggaccgagcgacggccaggcuucuuacaaaauuuuccgcaucgaaaagggcaaaaucgucaagagcguugagaugaaugcccccaacuaucauuacgaagagugcuccuguuacccugauucuagcgagauuacaugcgugugcagagacaauuggcacggguccaaccggcccugggugagcuuuaaucagaaccuggaauaucagaucggauacauuuguucuggcaucuucggggauaauccucgccccaacgacaaaaccggauccugcggcccggucagcucuaauggggcuaacggagugaagggcuuuuccuucaaguauggcaacgggguuuggauuggaagaacaaaaagcaucuccucucggagcggcuuugagaugauuugggauccuaauggguggaccggaaccgacaacaauuucuccaucaagcaagacaucgugggcauuaacgaauggucuggguacagcggcuccuuuguccagcaucccgagcuuacaggacuggauuguauccgcccuugcuucuggguggaacucauuagaggccggcccaaagagaauacgaucuggaccagcgggucuuccauuagcuucuguggaguuaacucugacacagugggcugguccuggcccgauggggccgagcugccuuuuaccaucgacaaguga

SEQ ID NO: 203402 - RNA, 1410 nt, Artificial Sequence; identical to SEQ ID NO: 199762
  derived and/or modified sequence opt5 from neuraminidase__InfluenzaA__ADX98893

SEQ ID NO: 203403 - RNA, 1410 nt, Artificial Sequence; identical to SEQ ID NO: 199762
  derived and/or modified sequence opt5 from neuraminidase__InfluenzaA__ADX98903

SEQ ID NO: 203404 - RNA, 1410 nt, Artificial Sequence; identical to SEQ ID NO: 201315
  derived and/or modified sequence opt5 from neuraminidase__InfluenzaA__ADX98913

SEQ ID NO: 203405 - RNA, 1410 nt, Artificial Sequence; identical to SEQ ID NO: 201193
  derived and/or modified sequence opt5 from neuraminidase__InfluenzaA__ADX98923

SEQ ID NO: 203406 - RNA, 1410 nt, Artificial Sequence; identical to SEQ ID NO: 201199
  derived and/or modified sequence opt5 from neuraminidase__InfluenzaA__ADX98933

SEQ ID NO: 203407 - RNA, 1410 nt, Artificial Sequence; identical to SEQ ID NO: 199762
  derived and/or modified sequence opt5 from neuraminidase__InfluenzaA__ADX98943

SEQ ID NO: 203408 - RNA, 1410 nt, Artificial Sequence; identical to SEQ ID NO: 201719
  derived and/or modified sequence opt5 from neuraminidase__InfluenzaA__ADX98953

SEQ ID NO: 203409 - RNA, 1410 nt, Artificial Sequence; identical to SEQ ID NO: 199762
  derived and/or modified sequence opt5 from neuraminidase__InfluenzaA__ADX98963

SEQ ID NO: 203410 - RNA, 1410 nt, Artificial Sequence
  derived and/or modified sequence opt5 from neuraminidase__InfluenzaA__ADX98973
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugaucugucccauuggggaggugccuucucccuacaacucccgcuuugaaagcguugccugguccgcuucugccugccacgacggaaucaauuggcugaccaucggcauuagcgggccugauaacggagcuguggccguccugaaguauaauggcaucauuacagacaccaucaaguccuggagaaacaauauucuccggacacaagagagcgagugugcgugcgugaacgggucuuguuucaccgugaugacggauggaccguccgacggccaggccagcuacaaaaucuuucgcaucgaaaagggcaaaauugucaagucuguugagaugaaugcucccaacuaucauuacgaagagugcagcuguuacccugauuccucugagaucacaugcgugugcagagacaauuggcacgggagcaaccggcccuggguguccuucaaucagaaccuggaauaucagauuggauacaucuguagcggcauuuuuggggauaauccucgccccaacgacaaaaccggaucuugcggcccggucuccagcaauggggccaacggagugaagggcuucucuuuuaaguauggcaacgggguuuggaucggaagaacaaaauccauuagcucccggaauggcuucgagaugaucugggauccuaacggguggaccggaaccgacaauaacuuuucuaucaagcaagacauugugggcaucaaugaauggagcggguacuccggcucuuucguccagcaucccgagcuuacaggacuggauuguauucgcccuugcuucuggguggaacucaucagaggccggcccaaagagaacacgauuuggaccagcggguccagcaucucuuuuuguggaguuaauuccgacacagugggcuggagcuggcccgauggggcugagcugccuuucaccaucgacaaguga

SEQ ID NO: 203411 - RNA, 1410 nt, Artificial Sequence; identical to SEQ ID NO: 199762
  derived and/or modified sequence opt5 from neuraminidase__InfluenzaA__ADX98983

SEQ ID NO: 203412 - RNA, 1410 nt, Artificial Sequence; identical to SEQ ID NO: 199762
  derived and/or modified sequence opt5 from neuraminidase__InfluenzaA__ADX98993

SEQ ID NO: 203413 - RNA, 1410 nt, Artificial Sequence; identical to SEQ ID NO: 199762
  derived and/or modified sequence opt5 from neuraminidase__InfluenzaA__ADX99003

SEQ ID NO: 203414 - RNA, 1365 nt, Artificial Sequence
  derived and/or modified sequence opt5 from neuraminidase__InfluenzaA__ADX99584
augaaccccaaucagaagaucaccacaauuggcagcaucugccugguggucgggcucauuucccugauccuucaaauuggaaacaucaucucuauuuggaucagccacuccauucagacgggcucucagaaucauaccgggaucuguaaccagaauauuaucacauacaaaaacagcaccuggguuaaggacacaaccuccgugauucugacaggaaauucuagccucugcccuaucagaggcugggccaucuauuccaaagauaacagcauucggaucgggucuaagggagacguguucgucauucgcgagccguuuaucuccuguagccaccuggaaugcagaaccuucuuucuuacgcaaggcgcucugcucaaugauaaacauucuaacggcaccgugaaggaccggucccccuaccgcgcccugaugagcuguccuguuggggaggcgcccucuccuuauaauuccagauucgaaagcguggcuugguccgccucugccugccacgauggaaugggcuggcugacaauugggaucagcggacccgacaacggcgcugucgccgugcucaaguacaaugggaucauuaccgagacaaucaaauccuggcggaagaaaauucugcgcacccaggaaagcgagugugcuugcguuaacggaucuuguuuuacgaucaugacagauggcccuuccgacggccuugccagcuauaagauuuucaaaaucgagaaggggaaggugaccaaaucuaucgaacugaaugcgccgaacagccauuacgaggaaugcuccuguuaucccgauacaggaaaggucaugugcgugugcagagacaacuggcacggcucuaaucggccuugggugagcuuugaucagaaccucgacuaccagauuggguacaucuguuccggagucuucggcgauaauccccgcccugaggacgggaccggaagcugcggccccguuuauguggacggcgccaacggggugaaaggauuuucuuacagauauggcaauggggucuggauuggacggaccaagucccacagcucucgccauggcuucgagaugaucugggauccgaacggguggacagaaacggacuccaaauuuagcgugagacaagauguuguggcuaugaccgacugguccggcuacucuggcagcuucguccagcacccugagcugacaggacuugauuguaugcggcccugcuuuuggguggaacugauucgcgggagaccuaaggagaaaaccaucuggacauccgccucuagcauuuccuucuguggaguuaauagcgacaccguggauuggucuuggcccgacggcgcugaacuccccuucuccaucgauaaguga

SEQ ID NO: 203415 - RNA, 1365 nt, Artificial Sequence; identical to SEQ ID NO: 203414
  derived and/or modified sequence opt5 from neuraminidase__InfluenzaA__ADX99595

SEQ ID NO: 203416 - RNA, 1365 nt, Artificial Sequence; identical to SEQ ID NO: 203414
  derived and/or modified sequence opt5 from neuraminidase__InfluenzaA__ADX99606

SEQ ID NO: 203417 - RNA, 1365 nt, Artificial Sequence; identical to SEQ ID NO: 203414
  derived and/or modified sequence opt5 from neuraminidase__InfluenzaA__ADX99617

SEQ ID NO: 203418 - RNA, 1365 nt, Artificial Sequence; identical to SEQ ID NO: 203414
  derived and/or modified sequence opt5 from neuraminidase__InfluenzaA__ADX99628

SEQ ID NO: 203419 - RNA, 1365 nt, Artificial Sequence; identical to SEQ ID NO: 203414
  derived and/or modified sequence opt5 from neuraminidase__InfluenzaA__ADX99639

SEQ ID NO: 203420 - RNA, 1365 nt, Artificial Sequence; identical to SEQ ID NO: 198743
  derived and/or modified sequence opt5 from neuraminidase__InfluenzaA__ADX99650

SEQ ID NO: 203421 - RNA, 1365 nt, Artificial Sequence; identical to SEQ ID NO: 198743
  derived and/or modified sequence opt5 from neuraminidase__InfluenzaA__ADX99672

SEQ ID NO: 203422 - RNA, 1365 nt, Artificial Sequence; identical to SEQ ID NO: 198743
  derived and/or modified sequence opt5 from neuraminidase__InfluenzaA__ADX99683

SEQ ID NO: 203423 - RNA, 1365 nt, Artificial Sequence; identical to SEQ ID NO: 198743
  derived and/or modified sequence opt5 from neuraminidase__InfluenzaA__ADX99694

SEQ ID NO: 203424 - RNA, 1365 nt, Artificial Sequence; identical to SEQ ID NO: 198743
  derived and/or modified sequence opt5 from neuraminidase__InfluenzaA__ADX99705

SEQ ID NO: 203425 - RNA, 1365 nt, Artificial Sequence; identical to SEQ ID NO: 198743
  derived and/or modified sequence opt5 from neuraminidase__InfluenzaA__ADX99846

SEQ ID NO: 203426 - RNA, 1365 nt, Artificial Sequence; identical to SEQ ID NO: 198743
  derived and/or modified sequence opt5 from neuraminidase__InfluenzaA__ADX99857

SEQ ID NO: 203427 - RNA, 1365 nt, Artificial Sequence; identical to SEQ ID NO: 198743
  derived and/or modified sequence opt5 from neuraminidase__InfluenzaA__ADX99868

SEQ ID NO: 203428 - RNA, 1365 nt, Artificial Sequence; identical to SEQ ID NO: 198743
  derived and/or modified sequence opt5 from neuraminidase__InfluenzaA__ADX99879

SEQ ID NO: 203429 - RNA, 1365 nt, Artificial Sequence; identical to SEQ ID NO: 198743
  derived and/or modified sequence opt5 from neuraminidase__InfluenzaA__ADX99890

SEQ ID NO: 203430 - RNA, 1365 nt, Artificial Sequence; identical to SEQ ID NO: 198743
  derived and/or modified sequence opt5 from neuraminidase__InfluenzaA__ADX99901

SEQ ID NO: 203431 - RNA, 1365 nt, Artificial Sequence
  derived and/or modified sequence opt5 from neuraminidase__InfluenzaA__ADX99912
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggguuaaggacaccacauccgugauccugaccggaaauucuagccucugcccuaucagaggcugggccauuuauuccaaagauaacagcauccggauugggucuaagggagacguguucaucauucgcgagccguuuaucuccuguagccaccuggaaugcagaacauucuuucuuacccaaggcgcucugcucaaugauaaacauucuuccggcacggucaaggaccggagccccuaccgcgcccugaugucuuguccugugggggaggcgcccuccccuuauaacagcagauucgaauccguugcuuggucugccagcgccugccacgauggaaugggcuggcugaccaucgggauuuccggacccgacaauggcgcuguggccguccucaaguacaacgggaucauuacagagaccaucaaaagcuggcggaagaaaauucugcgcacacaggaaucugagugugcuugcgugaauggauccuguuuuaccaucaugacggauggcccuagcgacggccuugccucuuauaagaucuucaaaauugagaaggggaagguuacaaaaagcaucgaacugaacgcgcccaauucccauuacgaggaaugcucuuguuauccggauaccggaaaggugaugugcgucugcagagacaacuggcacggcagcaaccggccuuggguguccuuugaucagaaucucgacuaccagauuggguacaucuguagcggaguguucggcgauaacccccgcccugaggacgggacaggaucuugcggccccgucuauguugacggcgccaauggggugaaaggauuuuccuacagauauggcaacgggguguggauuggacggaccaagagccacucuucccgccauggcuucgagaugaucugggauccgaauggguggaccgaaacagacagcaaauuuuccgucagacaagaugugguugcuaugacggacuggucuggcuacagcggauccuucgugcagcacccugagcugaccggccuugauuguaugcggcccugcuuuugggucgaacugauucgcgggagaccuaaggagaaaacaaucuggaccucugccagcuccaucagcuucuguggagugaacucugacacaguugauugguccuggcccgacggcgcugaacuccccuucagcauugauaaguga

SEQ ID NO: 203432 - RNA, 1365 nt, Artificial Sequence; identical to SEQ ID NO: 198743
  derived and/or modified sequence opt5 from neuraminidase__InfluenzaA__ADX99923

SEQ ID NO: 203433 - RNA, 1365 nt, Artificial Sequence; identical to SEQ ID NO: 198743
  derived and/or modified sequence opt5 from neuraminidase__InfluenzaA__ADX99934

SEQ ID NO: 203434 - RNA, 1365 nt, Artificial Sequence; identical to SEQ ID NO: 198743
  derived and/or modified sequence opt5 from neuraminidase__InfluenzaA__ADX99956

SEQ ID NO: 203435 - RNA, 1365 nt, Artificial Sequence; identical to SEQ ID NO: 198743
  derived and/or modified sequence opt5 from neuraminidase__InfluenzaA__ADX99967

SEQ ID NO: 203436 - RNA, 1365 nt, Artificial Sequence; identical to SEQ ID NO: 198743
  derived and/or modified sequence opt5 from neuraminidase__InfluenzaA__ADX99978

SEQ ID NO: 203437 - RNA, 1365 nt, Artificial Sequence; identical to SEQ ID NO: 198743
  derived and/or modified sequence opt5 from neuraminidase__InfluenzaA__ADX99989

SEQ ID NO: 203438 - RNA, 1365 nt, Artificial Sequence; identical to SEQ ID NO: 198743
  derived and/or modified sequence opt5 from neuraminidase__InfluenzaA__ADY00001

SEQ ID NO: 203439 - RNA, 1365 nt, Artificial Sequence; identical to SEQ ID NO: 198743
  derived and/or modified sequence opt5 from neuraminidase__InfluenzaA__ADY00012

SEQ ID NO: 203440 - RNA, 1365 nt, Artificial Sequence; identical to SEQ ID NO: 198743
  derived and/or modified sequence opt5 from neuraminidase__InfluenzaA__ADY00023

SEQ ID NO: 203441 - RNA, 1413 nt, Artificial Sequence
  derived and/or modified sequence opt5 from neuraminidase__InfluenzaA__ADY04729
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacaauggcgggcaauagcucccuguguagcauuucugggugggcuaucuacaccaaagauaacuccauucggaucggaagcaagggcgacgucuucgugauucgcgaaccuuuuaucucuugcucccaucuugaguguagaacguucuuucugacccaaggcgcccuccugaaugauaaacacagcaacgggacaguuaaggaccggucuccguaucgcgcccuuauguccugcccccugggagaagcuccuagccccuacaauuccaaguucgagucuguggccuggagcgcuuccgccugucaugauggcaugggguggcucaccaucggaauuagcggcccugacaacggggcggucgccgugcugaaauauaacggaaucauuacagaaaccaucaagucuuggaaaaagcagauucugagaacgcaggaguccgagugcguuugugugaauggcagcugcuuuacaaucaugaccgauggccccucuaacggggcugccagcuacaaaaucuucaagauugaaaagggaaaagucacaaaguccaucgagcucaaugcuccuaacuuucacuaugaagaguguucuugcuacccggacaccggcaccgugaugugugugugccgggauaauuggcacgggagcaaccgccccugggucuccuucaaucagaaccuggacuaccaaauuggauauaucugcagcggcguuuuuggggauaauccuagacccaaagacggagagggcucuuguaacccugugacaguggauggcgccaauggggucaagggauucuccuacaaauauggcaacgggguguggauuggacggacgaaguccaaucgccuuagaaaaggcuuugaaaugaucugggaccccaacggguggaccgacacagauucugacuucuccguuaagcaggauguggucgcgauuaccgacuggagcggcuacuccggaucuuuugugcagcauccggagcugacaggccucgauugcauccggccuuguuucuggguugaacuggugcgcgggcuucccaaggagaauaccacgaucuggacaagcggauccucuauuagcuucugcggcgucaacuccgacaccgccaacuggagcuggccugauggggcugaacugcccuuuaccaucgacaaauga

SEQ ID NO: 203442 - RNA, 1410 nt, Artificial Sequence; identical to SEQ ID NO: 202542
  derived and/or modified sequence opt5 from neuraminidase__InfluenzaA__ADY11828

SEQ ID NO: 203443 - RNA, 1410 nt, Artificial Sequence; identical to SEQ ID NO: 199623
  derived and/or modified sequence opt5 from neuraminidase__InfluenzaA__ADY11839

SEQ ID NO: 203444 - RNA, 1410 nt, Artificial Sequence; identical to SEQ ID NO: 199623
  derived and/or modified sequence opt5 from neuraminidase__InfluenzaA__ADY17657

SEQ ID NO: 203445 - RNA, 1410 nt, Artificial Sequence; identical to SEQ ID NO: 199623
  derived and/or modified sequence opt5 from neuraminidase__InfluenzaA__ADY17668

SEQ ID NO: 203446 - RNA, 1410 nt, Artificial Sequence; identical to SEQ ID NO: 199623
  derived and/or modified sequence opt5 from neuraminidase__InfluenzaA__ADY17679

SEQ ID NO: 203447 - RNA, 1410 nt, Artificial Sequence; identical to SEQ ID NO: 199623
  derived and/or modified sequence opt5 from neuraminidase__InfluenzaA__ADY17690

SEQ ID NO: 203448 - RNA, 1410 nt, Artificial Sequence; identical to SEQ ID NO: 199623
  derived and/or modified sequence opt5 from neuraminidase__InfluenzaA__ADY17701

SEQ ID NO: 203449 - RNA, 1410 nt, Artificial Sequence; identical to SEQ ID NO: 199762
  derived and/or modified sequence opt5 from neuraminidase__InfluenzaA__ADY38722

SEQ ID NO: 203450 - RNA, 1410 nt, Artificial Sequence; identical to SEQ ID NO: 201511
  derived and/or modified sequence opt5 from neuraminidase__InfluenzaA__ADY38723

SEQ ID NO: 203451 - RNA, 1410 nt, Artificial Sequence; identical to SEQ ID NO: 199762
  derived and/or modified sequence opt5 from neuraminidase__InfluenzaA__ADY38734

SEQ ID NO: 203452 - RNA, 1410 nt, Artificial Sequence; identical to SEQ ID NO: 201354
  derived and/or modified sequence opt5 from neuraminidase__InfluenzaA__ADY38753

SEQ ID NO: 203453 - RNA, 1410 nt, Artificial Sequence; identical to SEQ ID NO: 199762
  derived and/or modified sequence opt5 from neuraminidase__InfluenzaA__ADY38763

SEQ ID NO: 203454 - RNA, 1410 nt, Artificial Sequence; identical to SEQ ID NO: 199762
  derived and/or modified sequence opt5 from neuraminidase__InfluenzaA__ADZ04600

SEQ ID NO: 203455 - RNA, 1410 nt, Artificial Sequence; identical to SEQ ID NO: 199762
  derived and/or modified sequence opt5 from neuraminidase__InfluenzaA__ADZ04610

SEQ ID NO: 203456 - RNA, 1410 nt, Artificial Sequence; identical to SEQ ID NO: 199762
  derived and/or modified sequence opt5 from neuraminidase__InfluenzaA__ADZ04693

SEQ ID NO: 203457 - RNA, 1410 nt, Artificial Sequence; identical to SEQ ID NO: 199762
  derived and/or modified sequence opt5 from neuraminidase__InfluenzaA__ADZ04701

SEQ ID NO: 203458 - RNA, 1410 nt, Artificial Sequence; identical to SEQ ID NO: 199762
  derived and/or modified sequence opt5 from neuraminidase__InfluenzaA__ADZ04711

SEQ ID NO: 203459 - RNA, 1410 nt, Artificial Sequence
  derived and/or modified sequence opt5 from neuraminidase__InfluenzaA__ADZ05393
augaaccccaaucagaagaucauuaccaucgacagcgugugcaugacaauuggcauggccaaccugauccuccaaauugggaauaucaucuccauuuggaucucucacagcauucagcugggaaaccagaaucagaucgagacguguaaccaauccgucauuaccuacgaaaauaacacauggguuaaucagaccuaugugaacaucucuaauacaaacuucgcugccggccagagcguggucuccgugaaacuugcgggaaauucuagccugugcccuguuuccgggugggcuauuuacagcaaggauaacucugugagaaucggcuccaaaggggacgucuuugugauccgggagccguucauuagcuguucuccccucgaaugccgcaccuuuuuccugacacagggagcccuucugaaugauaagcauuccaacggcaccaucaaagacagaagcccuuaucggacgcucaugucuugucccauuggcgagguuccuucccccuacaacagccgcuuugaauccguggccuggucugcuagcgccugccacgaugggaucaauuggcugaccauuggaaucuccggcccugacaacggggcugucgccgugcugaaguauaauggaaucauuacagauaccaucaagagcuggagaaacaauauucuccggacacaagagucugagugugcgugcgugaacggcuccuguuucaccgucaugacggacgggccgagcaauggacaggccucuuacaaaaucuuucgcauugaaaagggcaaaaucguuaagagcguggagaugaacgcucccaauuaucauuacgaagagugcuccuguuacccugauucuagcgagaucacaugcgugugcagagacaacuggcacggcuccaaucggcccugggucagcuucaaccagaaucuggaauaucagauuggguacaucuguucuggaauuuuuggcgauaacccucgccccaaugacaaaaccggguccugcggaccggugagcucuaacggcgccaacgggguuaagggauucuccuuuaaguauggcaauggcguguggaucgggagaacaaaaagcauuuccucucggaacggauucgagaugaucugggauccuaauggcuggaccgggaccgacaacaauuuuagcauuaagcaagacaucgucggaaucaacgaaugguccggcuacucugggagcuucgugcagcaucccgagcuuacaggccuggauuguauucgcccuugcuucuggguugaacucaucagaggacggcccaaagagaauacgauuuggaccuccggcagcucuaucuccuuuuguggggugaacagcgacacagucggauggucuuggcccgauggcgcugagcugccuuucaccauugacaaguga

SEQ ID NO: 203460 - RNA, 1413 nt, Artificial Sequence
  derived and/or modified sequence opt5 from neuraminidase__InfluenzaA__ADZ05837
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccugugagaacuccacaugggugaaucauaccuacgugaacaucaauaacacaaauguuguggccggagaagacaaaaccucugugacacuggcgggcaacagcucccuuugcagcauuucugggugggcuaucuauaccaaggauaauuccauucggaucggaagcaaaggcgacgucuucgugauucgcgagccuuuuaucucuuguucccaccuggaaugcagaacguucuuucucacccaaggcgcccugcuuaacgauaagcauagcaaugggacaguuaaagaccggucuccguaccgcgcccugauguccuguccccucggagaggcuccuagccccuauaacuccaaguucgaaucuguggccuggagcgcuuccgccugccacgauggcaugggguggcugaccaucggaauuagcggcccugacaacggggcggucgccgugcugaaguacaauggaaucauuacaggcaccaucaaaucuuggaagaaacagauucucagaacgcaggaguccgaguguguuugcaugaacggcagcuguuuuacaaucaugaccgaugggcccucuaauaaggcugccagcuauaaaaucuucaagauugaaaagggaaaagugacaaaguccaucgagcugaacgcuccuaauuuuuacuaugaagagugcucuuguuacccggacaccggcauugucaugugcgugugccgggauaacuggcaugggagcaaucgccccuggguguccuucaaccagaaucuugacuaccaaaucggauauauuuguagcggcgucuuuggggauaacccuagacccgaggacggagaaggcucuugcaauccuguuaccguggauggcgccaacggggugaaaggauucuccuacaaguauggcaauggggucuggaucggacggacaaaaagcaaccgccugagaaagggcuuugagaugauuugggaccccaauggguggacgaacaccgacucugauuucuccgugaaacaggacguuguggcgacaaccgauuggagcggcuacuccggaucuuuuguccagcacccggaacucacaggccuggacuguauccggccuugcuucuggguggagcuuguucgcgggcugcccagagaaaacaccacgaucuggacaagcggauccucuauuagcuucuguggcgucaauuccgauaccgccaacuggagcuggccugacggggcugagcuccccuuuaccaucgauaaguga

SEQ ID NO: 203461 - RNA, 1413 nt, Artificial Sequence; identical to SEQ ID NO: 200485
  derived and/or modified sequence opt5 from neuraminidase__InfluenzaA__ADZ05848

SEQ ID NO: 203462 - RNA, 1410 nt, Artificial Sequence; identical to SEQ ID NO: 200929
  derived and/or modified sequence opt5 from neuraminidase__InfluenzaA__ADZ05858

SEQ ID NO: 203463 - RNA, 1410 nt, Artificial Sequence; identical to SEQ ID NO: 199762
  derived and/or modified sequence opt5 from neuraminidase__InfluenzaA__ADZ47841

SEQ ID NO: 203464 - RNA, 1410 nt, Artificial Sequence; identical to SEQ ID NO: 199762
  derived and/or modified sequence opt5 from neuraminidase__InfluenzaA__ADZ47851

SEQ ID NO: 203465 - RNA, 1410 nt, Artificial Sequence
  derived and/or modified sequence opt5 from neuraminidase__InfluenzaA__ADZ47861
augaaccccaaucagaagaucauuaccaucggcagcgugugcaugacaauugggcuggccaaccucauccugcaaauuggaaauaucaucuccauuuggaucucucacagcauucagcuuggcaaccagaaucagaucgagacguguaaccaauccgucauuaccuacgaaaauaacacauggguuaaucagaccuaugugaacaucucuaauauuaacuucgcugccgggcagagcguggucuccgugaaacuggcgggaaauucuagccucugcccuguuuccggcugggcuaucuacagcaaggacaacucugugagaaucggguccaaaggagaugucuuugugauucgggagccguucaucagcuguucuccccuggaaugccgcacauuuuuccuuacccagggcgcccugcucaaugacaagcauuccaacggcacaauuaaagauagaagcccuuaucggacccugaugucuugucccaucggggagguuccuucccccuacaacagccgcuuugaauccguggccuggucugcuagcgccugccacgacggaauuaauuggcugacgaucggcaucuccgggccugauaacggagcugucgccgugcucaaguauaauggcauuaucaccgacacaauuaagagcuggagaaacaauauccugcggacccaagagucugagugugcgugcgugaacggguccuguuucacagucaugaccgauggaccgagcgacggccaggccucuuacaaaauuuuucgcaucgaaaagggcaaaaucguuaagagcguggagaugaaugcucccaacuaucauuacgaagagugcuccuguuacccugauucuagcgagauuacgugcgugugcagagacaauuggcacggguccaaccggcccugggucagcuucaaucagaaccuugaauaucgcaucggauacauuuguucuggcaucuuuggggauaauccuagacccaacgacaaaacaggauccugcggcccggugagcucuaauggggccaacggaguuaagggcuucuccuuuaaguauggcaacgggguguggauuggacggaccaaaagcaucuccucucgcaauggcuucgagaugauuugggauccuaacggguggacaggaaccgacaagaauuuuagcaucaaacaggacaucgucggcauuaacgaaugguccggguacucuggcagcuucgugcaacaucccgagcugaccggacucgauuguaucagaccuugcuucuggguugaacugauucggggccgccccaaggagaauacaaucuggacguccgggagcucuauuuccuuuuguggagugaacagcgacaccgucggcuggucuuggcccgauggggcugagcuuccuuucacaaucgacaaauga

SEQ ID NO: 203466 - RNA, 1413 nt, Artificial Sequence
  derived and/or modified sequence opt5 from neuraminidase__InfluenzaA__ADZ53101
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaaaguuguggccggagaagacaagaccucugugacacuggcgggcaauagcucccuuuguagcauuucugggugggcuaucaacaccaaagauaauuccauucggaucggaagcaagggcgacgucuucgugauucgcgagccuuuuaucucuugcucccaccuggaauguagaacguucuuucucacccaaggcgcccugcuuaacgauaaacauagcaaugggacaguuaaggaccggucuccguaccgcgcccugauguccugcccccucggagaggcuccuagccccuauaacuccaaguucgaaucuguggccuggagcgcuuccgccugucacgauggcaugggguggcugaccaucggaauuagcggcccugacaacggggcggucgccgugcugaaauacaauggaaucauuacaggcaccaucaagucuuggaaaaagcagauucucagaacgcaggaguccgagugcguuuguaugaacggcagcugcuuuacaaucaugaccgaugggcccucuaauaaagcugccagcuauaagaucuucaagauugaaaaaggaaaggugacaaaauccaucgagcugaacgcuccuaauuuuuacuaugaagaguguucuugcuacccggacaccggcauugucaugugugugugccgggauaacuggcaugggagcaaucgccccuggguguccuucaaccagaaucuugacuaccaaaucggauauauuugcagcggcgucuuuggggauaacccuagacccgaggacggagaaggcucuuguaauccuguuaccguggauggcgccaacggggugaagggauucuccuacaaauauggcaauggggucuggaucggacggacaaagagcaaccgccugagaaaaggcuuugagaugauuugggaccccaauggguggacgaacaccgacucugauuucuccgugaagcaggacguuguggcgaucacagauuggagcggcuacuccggaucuuuuguccagcacccggaacucaccggccuggacugcauccggccuuguuucuggguggagcuuguucgcgggcugcccagagaaaacacaaccauuuggacgagcggauccucuaucagcuucugcggcgucaauuccgauacagccaacuggagcuggccugacggggcugagcuccccuuuaccauugauaaguga

SEQ ID NO: 203467 - RNA, 1410 nt, Artificial Sequence
  derived and/or modified sequence opt5 from neuraminidase__InfluenzaA__ADZ53124
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaaugacuuuagcaucaagcaagauaucgugggcauuaacgaaugguccggguauucuggcagcuucguccagcaccccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 203468 - RNA, 1410 nt, Artificial Sequence; identical to SEQ ID NO: 199762
  derived and/or modified sequence opt5 from neuraminidase__InfluenzaA__ADZ53130

SEQ ID NO: 203469 - RNA, 1410 nt, Artificial Sequence; identical to SEQ ID NO: 199752
  derived and/or modified sequence opt5 from neuraminidase__InfluenzaA__ADZ53132

SEQ ID NO: 203470 - RNA, 1410 nt, Artificial Sequence; identical to SEQ ID NO: 199762
  derived and/or modified sequence opt5 from neuraminidase__InfluenzaA__ADZ53134

SEQ ID NO: 203471 - RNA, 1410 nt, Artificial Sequence; identical to SEQ ID NO: 199762
  derived and/or modified sequence opt5 from neuraminidase__InfluenzaA__ADZ53136

SEQ ID NO: 203472 - RNA, 1410 nt, Artificial Sequence; identical to SEQ ID NO: 200116
  derived and/or modified sequence opt5 from neuraminidase__InfluenzaA__ADZ53137

SEQ ID NO: 203473 - RNA, 1410 nt, Artificial Sequence; identical to SEQ ID NO: 199762
  derived and/or modified sequence opt5 from neuraminidase__InfluenzaA__ADZ53139

SEQ ID NO: 203474 - RNA, 1410 nt, Artificial Sequence
  derived and/or modified sequence opt5 from neuraminidase__InfluenzaA__ADZ53141
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaaugacuuuagcaucaagcaagauaucgugggcauuaacgaaugguccggguacucuggcagcuucguccagcauuccgagcuuacaggacuggacuguauccgccccugcuucuggguggaacucauuagaggccggccuaaagagaauacgaucuggaccagcgggucuuccauuagcuuuuguggaguuaacucugauacagugggcugguccuggcccgacggggcugagcugcccuucaccaucgauaaguga

SEQ ID NO: 203475 - RNA, 1410 nt, Artificial Sequence; identical to SEQ ID NO: 199623
  derived and/or modified sequence opt5 from neuraminidase__InfluenzaA__AEA03712

SEQ ID NO: 203476 - RNA, 1410 nt, Artificial Sequence; identical to SEQ ID NO: 199623
  derived and/or modified sequence opt5 from neuraminidase__InfluenzaA__AEA03722

SEQ ID NO: 203477 - RNA, 1410 nt, Artificial Sequence; identical to SEQ ID NO: 199623
  derived and/or modified sequence opt5 from neuraminidase__InfluenzaA__AEA03744

SEQ ID NO: 203478 - RNA, 1410 nt, Artificial Sequence
  derived and/or modified sequence opt5 from neuraminidase__InfluenzaA__AEA03755
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucggggccgcacgccguauagaacacuccugaugaaugaacugggggugcccuuucaccucggaaccaagcaggucugcauugccugguccucuagcuccugucaugauggcaaagccuggcugcacgugugcaucacaggcgacgauaagaacgcuaccgccagcuucauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuauccuagauaccccggggugcggugugucugccgcgauaacuggaagggaagcaauagaccuaucguggacauuaacaucaaagaucacucuauuguuuccagcuacguguguucuggccuugucggcgacacgccccggaagaaugacagcuccucuagcucccauugccuggauccgaacaaugaggaagggggacacggcgugaaagggugggccuucgacgauggaaacgacguuuggaugggccgcaccaucagcgagaagucuagacucggguaugagacauuuaaagugaucgaaggaugguccaauccuaagagcaaacugcagauuaaccggcaggucaucguggaucgcggcaauagaucuggcuacuccgggauuuucagcgucgagggaaaguccuguaucaaccggugcuuuuauguggaacugauuagaggccgcaaggaggaaaccgagguucucuggaccucuaauagcaucguggucuucugugggacauccggaaccuacggcacagggucuuggcccgacggcgcugauauuaaccugaugccuaucuga

SEQ ID NO: 203479 - RNA, 1410 nt, Artificial Sequence; identical to SEQ ID NO: 199623
  derived and/or modified sequence opt5 from neuraminidase__InfluenzaA__AEA03766

SEQ ID NO: 203480 - RNA, 1410 nt, Artificial Sequence; identical to SEQ ID NO: 199623
  derived and/or modified sequence opt5 from neuraminidase__InfluenzaA__AEA03796

SEQ ID NO: 203481 - RNA, 1410 nt, Artificial Sequence; identical to SEQ ID NO: 199623
  derived and/or modified sequence opt5 from neuraminidase__InfluenzaA__AEA03806

SEQ ID NO: 203482 - RNA, 1410 nt, Artificial Sequence
  derived and/or modified sequence opt5 from neuraminidase__InfluenzaA__AEA03817
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugaccgguguuaccaauucgcucuugggcagggaaccacacugaauaacgugcauagcaauaacaccguucgcgauagaacgccguaucggacacuccugaugaaugaacugggcgugcccuuucaccucgggaccaagcaggucugcauugccugguccucuagcuccugucaugacggaaaggccuggcugcacgugugcaucacaggcgaugacaaaaacgcuaccgccagcuucauuuacaauggccgccuuguugauucuguggucuccuggagcaaggagauccugagaacccaggaaucugagugugugugcauuaacgggacauguacgguggucaugaccgacggauccgcuagcggcaaagccgauacaaagauccucuuuaucgaggaagggaaaauuguucauaccuccacacugucuggaagcgcgcaacacguggaggaaugcuccugcuauccucgguaccccggcgugcgcugugucugcagagacaacuggaaggggagcaaucggccuaucguggauauuaacaucaaggaccacucuauuguuuccagcuacguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucagcgagaaaucucggcucggcuaugagacauuuaaggugaucgaagggugguccaauccuaaaagcaagcugcagauuaaccgccaggucaucguggacagaggaaaucggucuggcuacuccggcauuuucagcgucgaggggaaauccuguaucaacagaugcuuuuauguggaacugauucgcggacggaaggaggaaaccgagguucucuggaccucuaauagcaucguggucuucuguggcacauccgggaccuacggaacaggcucuuggcccgauggggcugacauuaaccugaugccuaucuga

SEQ ID NO: 203483 - RNA, 1410 nt, Artificial Sequence; identical to SEQ ID NO: 199623
  derived and/or modified sequence opt5 from neuraminidase__InfluenzaA__AEA03828

SEQ ID NO: 203484 - RNA, 1410 nt, Artificial Sequence; identical to SEQ ID NO: 199623
  derived and/or modified sequence opt5 from neuraminidase__InfluenzaA__AEA03838

SEQ ID NO: 203485 - RNA, 1410 nt, Artificial Sequence; identical to SEQ ID NO: 202779
  derived and/or modified sequence opt5 from neuraminidase__InfluenzaA__AEA03849

SEQ ID NO: 203486 - RNA, 1410 nt, Artificial Sequence; identical to SEQ ID NO: 199623
  derived and/or modified sequence opt5 from neuraminidase__InfluenzaA__AEA03860

SEQ ID NO: 203487 - RNA, 1410 nt, Artificial Sequence
  derived and/or modified sequence opt5 from neuraminidase__InfluenzaA__AEA03871
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaucaccgacggauccgcuagcggcaaggccgauacaaaaauccucuuuauugaggaagggaagaucguucauaccuccacacugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugauugaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaaccgagguucucuggaccucuaauagcauuguggucuucuguggcacauccgggaccuacggaacaggcucuuggcccgauggggcugacaucaaccugaugccuaucuga

SEQ ID NO: 203488 - RNA, 1410 nt, Artificial Sequence; identical to SEQ ID NO: 199623
  derived and/or modified sequence opt5 from neuraminidase__InfluenzaA__AEA03879

SEQ ID NO: 203489 - RNA, 1410 nt, Artificial Sequence
  derived and/or modified sequence opt5 from neuraminidase__InfluenzaA__AEA03889
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaagguucgggaucgcaccccguauagaacgcuccugaugaaugaacugggcgugcccuuucaccucgggacaaaacaggucugcauugccugguccucuagcuccugucaugacggaaaggccuggcugcacgugugcaucaccggcgaugacaaaaacgcuacagccagcuucauuuacaauggccggcuuguugauucuguggucuccuggagcaaggagauccugcgcacccaggaaucugagugugugugcauuaacgggaccuguacaguggucaugacggacggauccgcuagcggcaaagccgauaccaagauccucuuuaucgaggaagggaagauuguucauacauccacccugucuggaagcgcgcaacacguggaggaaugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccaucagcgagaaaucuagacucggcuaugagacguuuaaggugaucgaagggugguccaauccuaaaagcaagcugcagauuaaccggcaggucaucguggaccgcggaaauagaucuggcuacuccggcauuuucagcgucgaggggaaguccuguaucaaccggugcuuuuauguggaacugauuagaggacgcaaagaggaaacagagguucucuggaccucuaauagcaucguggucuucuguggcaccuccgggacauacggaaccggcucuuggcccgauggggcugacauuaaccugaugccuaucuga

SEQ ID NO: 203490 - RNA, 1410 nt, Artificial Sequence
  derived and/or modified sequence opt5 from neuraminidase__InfluenzaA__AEA03898
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagucugauuccucuagcuccagccauugccuggacccgaauaacgaggaaggcgggcacggagugaaaggcugggccuucgaugacgggaaugauguuuggaugggacgcaccaucucugagaaguccagacucggcuaugagacauuuaaagugaucgaaggguggagcaacccuaagucuaaacugcagauuaaucggcaggucaucguggaccgcggaaacagauccggcuacagcggcauuuucuccgucgaggggaagucuuguaucaaucggugcuuuuauguggaacugauuagaggacgcaaggaggaaaccgagguucucuggaccagcaacuccaucguggucuucuguggcacaucugggaccuacggaacaggcagcuggcccgauggggcugacauuaaucugaugccuaucuga

SEQ ID NO: 203491 - RNA, 1410 nt, Artificial Sequence; identical to SEQ ID NO: 199623
  derived and/or modified sequence opt5 from neuraminidase__InfluenzaA__AEA03909

SEQ ID NO: 203492 - RNA, 1410 nt, Artificial Sequence
  derived and/or modified sequence opt5 from neuraminidase__InfluenzaA__AEA03924
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuauccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccggggaaauagaucuggcuacuccggcaucuucagcguggaggggaaguccuguauuaaccggugcuuuuaugucgaacugaucagaggacgcaaggaggaaaccgaggugcucuggaccucuaauagcauuguuguguucuguggcacauccgggaccuacggaacaggcucuuggcccgauggggcugacaucaaccugaugccuaucuga

SEQ ID NO: 203493 - RNA, 1410 nt, Artificial Sequence; identical to SEQ ID NO: 199623
  derived and/or modified sequence opt5 from neuraminidase__InfluenzaA__AEA03935

SEQ ID NO: 203494 - RNA, 1410 nt, Artificial Sequence
  derived and/or modified sequence opt5 from neuraminidase__InfluenzaA__AEA03946
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcgaggaaauccugcgcacccaggagucugagugugugugcauuaacgggacauguacgguggucaugaccgacggauccgcuagcggcaaagccgauacaaagauccucuuuaucgaagaggggaaaauuguucauaccuccacacugucuggaagcgcgcaacacguggaagagugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucagcgagaaaucuagacucggcuaugaaacauuuaaggugaucgaggggugguccaauccuaaaagcaagcugcagauuaaccggcaggucaucguggaccgcggaaauagaucuggcuacuccggcauuuucagcgucgaagggaaauccuguaucaaccggugcuuuuauguggagcugauuagaggacgcaaggaagagaccgagguucucuggaccucuaauagcaucguggucuucuguggcacauccgggaccuacggaacaggcucuuggcccgauggggcugacauuaaccugaugccuaucuga

SEQ ID NO: 203495 - RNA, 1410 nt, Artificial Sequence
  derived and/or modified sequence opt5 from neuraminidase__InfluenzaA__AEA03957
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauagcaagucuaaacugcagauuaaccggcaggucaucguggaccgcggaaauagauccggcuacagcggcauuuucuccgucgaggggaagucuuguaucaaccggugcuuuuauguggaacugauuagaggacgcaaggaggaaaccgagguucucuggaccagcaauuccaucguggucuucuguggcacaucugggaccuacggaacaggcagcuggccugauggggcugacauuaaccugaugcccaucuga

SEQ ID NO: 203496 - RNA, 1410 nt, Artificial Sequence; identical to SEQ ID NO: 199623
  derived and/or modified sequence opt5 from neuraminidase__InfluenzaA__AEA03989

SEQ ID NO: 203497 - RNA, 1410 nt, Artificial Sequence; identical to SEQ ID NO: 202779
  derived and/or modified sequence opt5 from neuraminidase__InfluenzaA__AEA04000

SEQ ID NO: 203498 - RNA, 1410 nt, Artificial Sequence; identical to SEQ ID NO: 199623
  derived and/or modified sequence opt5 from neuraminidase__InfluenzaA__AEA04011

SEQ ID NO: 203499 - RNA, 1410 nt, Artificial Sequence; identical to SEQ ID NO: 202779
  derived and/or modified sequence opt5 from neuraminidase__InfluenzaA__AEA04022

SEQ ID NO: 203500 - RNA, 1410 nt, Artificial Sequence; identical to SEQ ID NO: 199623
  derived and/or modified sequence opt5 from neuraminidase__InfluenzaA__AEA04033

SEQ ID NO: 203501 - RNA, 1410 nt, Artificial Sequence; identical to SEQ ID NO: 199623
  derived and/or modified sequence opt5 from neuraminidase__InfluenzaA__AEA04044

SEQ ID NO: 203502 - RNA, 1410 nt, Artificial Sequence; identical to SEQ ID NO: 199623
  derived and/or modified sequence opt5 from neuraminidase__InfluenzaA__AEA04049

SEQ ID NO: 203503 - RNA, 1410 nt, Artificial Sequence; identical to SEQ ID NO: 199623
  derived and/or modified sequence opt5 from neuraminidase__InfluenzaA__AEA04059

SEQ ID NO: 203504 - RNA, 1410 nt, Artificial Sequence; identical to SEQ ID NO: 199623
  derived and/or modified sequence opt5 from neuraminidase__InfluenzaA__AEA04070

SEQ ID NO: 203505 - RNA, 1410 nt, Artificial Sequence; identical to SEQ ID NO: 202779
  derived and/or modified sequence opt5 from neuraminidase__InfluenzaA__AEA04081

SEQ ID NO: 203506 - RNA, 1410 nt, Artificial Sequence; identical to SEQ ID NO: 199623
  derived and/or modified sequence opt5 from neuraminidase__InfluenzaA__AEA04092

SEQ ID NO: 203507 - RNA, 1410 nt, Artificial Sequence; identical to SEQ ID NO: 199623
  derived and/or modified sequence opt5 from neuraminidase__InfluenzaA__AEA04103

SEQ ID NO: 203508 - RNA, 1410 nt, Artificial Sequence; identical to SEQ ID NO: 199623
  derived and/or modified sequence opt5 from neuraminidase__InfluenzaA__AEA04125

SEQ ID NO: 203509 - RNA, 1410 nt, Artificial Sequence; identical to SEQ ID NO: 199623
  derived and/or modified sequence opt5 from neuraminidase__InfluenzaA__AEA04133

SEQ ID NO: 203510 - RNA, 1410 nt, Artificial Sequence
  derived and/or modified sequence opt5 from neuraminidase__InfluenzaA__AEA04144
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuauccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccggggaaauagaucuggcuacuccggcaucuucagcguggaggggaaguccuguauuaaccggugcuuuuaugucgaacugaucagaggacgcaaggaggaaaccgaggugcucuggaccucuaauagcauuaucguuuucuguggcacauccgggaccuacggaacaggcucuuggcccgauggggcugacaucaaccugaugccuauuuga

SEQ ID NO: 203511 - RNA, 1410 nt, Artificial Sequence; identical to SEQ ID NO: 199623
  derived and/or modified sequence opt5 from neuraminidase__InfluenzaA__AEA04155

SEQ ID NO: 203512 - RNA, 1410 nt, Artificial Sequence; identical to SEQ ID NO: 199623
  derived and/or modified sequence opt5 from neuraminidase__InfluenzaA__AEA04166

SEQ ID NO: 203513 - RNA, 1410 nt, Artificial Sequence
  derived and/or modified sequence opt5 from neuraminidase__InfluenzaA__AEA04177
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucggaaucgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaucaaagaucacucuauuguuuccagcuacguguguucuggacuugucggcgacacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgaggggaaguccuguaucaaucggugcuuuuauguggaacugauuagaggacgcaaggaggaaaccgagguucucuggaccucuaacagcaucguggucuucuguggcacauccgggaccuacggaacaggcucuuggcccgacggggcugauauuaaucugaugccuaucuga

SEQ ID NO: 203514 - RNA, 1410 nt, Artificial Sequence; identical to SEQ ID NO: 199623
  derived and/or modified sequence opt5 from neuraminidase__InfluenzaA__AEA04188

SEQ ID NO: 203515 - RNA, 1410 nt, Artificial Sequence; identical to SEQ ID NO: 200616
  derived and/or modified sequence opt5 from neuraminidase__InfluenzaA__AEA04199

SEQ ID NO: 203516 - RNA, 1410 nt, Artificial Sequence; identical to SEQ ID NO: 199623
  derived and/or modified sequence opt5 from neuraminidase__InfluenzaA__AEA04210

SEQ ID NO: 203517 - RNA, 1410 nt, Artificial Sequence; identical to SEQ ID NO: 200616
  derived and/or modified sequence opt5 from neuraminidase__InfluenzaA__AEA04229

SEQ ID NO: 203518 - RNA, 1410 nt, Artificial Sequence; identical to SEQ ID NO: 200616
  derived and/or modified sequence opt5 from neuraminidase__InfluenzaA__AEA04239

SEQ ID NO: 203519 - RNA, 1410 nt, Artificial Sequence
  derived and/or modified sequence opt5 from neuraminidase__InfluenzaA__AEA04250
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugaauaacgugcauagcaauaacacgguucgggugcgcacaccguacagaacccuccugaugaaugaacugggcguccccuuucaccucgggacaaaacagguguguaucgccugguccucuagcuccugccaugauggaaaggccuggcugcacguuuguauuaccggcgacgauaagaacgcuaccgccagcuucaucuauaauggccggcuuguggacucugucguguccuggagcaaagagauucugcgcacacaggaaucugagugcguguguaucaacgggacgugcaccgucguuaugacagauggauccgcuagcggcaaggccgacaccaaaauucucuuuaucgaggaagggaagaucgugcauacauccacccugucuggaagcgcgcaacacguggaggaaugcuccuguuacccuagauaucccggcguccggugcgugugucgcgauaacuggaaggggagcaauagaccuauuguugacaucaacauuaaagaucacucuaucguguccagcuacgucugcucuggacuugugggcgacacgccccggaagaaugacagcuccucuagcucccauugucuggauccgaacaaugaggaaggcgggcacggaguuaaaggcugggccuucgacgaugggaacgacguguggaugggacgcacaauuagcgagaagucuagacucggcuacgagaccuuuaaagucaucgaagggugguccaauccuaagagcaaacugcagaucaaccgccaggugauugucgaucggggaaauagaucuggcuauuccggcaucuucagcguggaggggaaguccugcauuaaccgguguuuuuacguugaacugaucagaggacgcaaggaggaaaccgaggugcucuggacaucuaauagcauugucguguucugcggcaccuccgggacauauggaacgggcucuuggcccgacggggcugauaucaaccugaugccuauuuga

SEQ ID NO: 203520 - RNA, 1410 nt, Artificial Sequence; identical to SEQ ID NO: 200616
  derived and/or modified sequence opt5 from neuraminidase__InfluenzaA__AEA04260

SEQ ID NO: 203521 - RNA, 1410 nt, Artificial Sequence
  derived and/or modified sequence opt5 from neuraminidase__InfluenzaA__AEA04268
augaaccccaaucagaagaucauuaccaucggcagcgugucccugacaauuucuacgaucugccucuucaugcaaaccgccauucugaucacaaccgucacacuucacuuuaaacagugugaguucaacagcccuccgaauaaccaggcuaugcugugcgaacccaccaucauugagagaaauaucacagaaauuguuuaccucaccaacacgaccaucgagaaggaaauuuguccuaaacuggccgaguaucggaauugguccaagccccagugcgacaucacaggguuugcgccuuucucuaaagauaacagcauucgccuuuccgcuggaggcgacaucugggugaccagagagcccuacgugucuugugauccugacaagugcuaucaauuugcccuggggcagggaacaacccucaauaacguccauagcaauaacacggugcgggaucgcacaccguacagaacccugcugaugaaugaacucggcguucccuuccaccuggggacaaaacagguguguaucgccugguccucuagcuccugccaugacggaaaggcuuggcuucacgucuguauuaccggcgaugacaagaacgccaccgcuagcuuuaucuauaauggccggcugguggauucuguuguguccuggagcaaagagauucuccgcacacaggaaucugagugcgucuguaucaacgggacgugcaccguggugaugacagacggauccgccagcggcaaggcggauaccaaaauucuguucaucgaggaagggaagaucguccauacauccacccuuucuggaagcgcccaacacguugaggaaugcuccuguuacccuagauaucccggcgugcggugcgugugucgcgacaacuggaaggggagcaauagaccuauugucgauaucaacauuaaagaccacucuaucguguccagcuacguuugcucuggacuggugggcgacacgccccggaagaaugauagcuccucuagcucccauugucucgacccgaacaaugaggaaggcgggcacggagucaaaggcugggcuuuugaugacgggaacgauguguggaugggacgcacaauuagcgagaagucuagacugggcuacgagaccuucaaaguuaucgaagggugguccaauccuaagagcaaacugcagaucaaccgccaggugauugucgaccggggaaauagaucuggcuauuccggcaucuuuagcguggaggggaaguccugcauuaaccgguguuucuacgucgaacucaucagaggacgcaaggaggaaaccgaggugcuguggacaucuaauagcauuguuguguuuugcggcaccuccgggacauauggaacgggcucuuggcccgauggggccgacaucaaccuuaugccuauuuga

SEQ ID NO: 203522 - RNA, 1410 nt, Artificial Sequence; identical to SEQ ID NO: 200616
  derived and/or modified sequence opt5 from neuraminidase__InfluenzaA__AEA04276

SEQ ID NO: 203523 - RNA, 1410 nt, Artificial Sequence; identical to SEQ ID NO: 200616
  derived and/or modified sequence opt5 from neuraminidase__InfluenzaA__AEA04287

SEQ ID NO: 203524 - RNA, 1410 nt, Artificial Sequence; identical to SEQ ID NO: 200616
  derived and/or modified sequence opt5 from neuraminidase__InfluenzaA__AEA04298

SEQ ID NO: 203525 - RNA, 1410 nt, Artificial Sequence
  derived and/or modified sequence opt5 from neuraminidase__InfluenzaA__AEA04307
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugaauaacgugcauagcaauaacacgguucgggaucgcacaccguacagaacccuccugaugaaugaacugggcgugcccuuucaccucgggacaaagcaggucuguaucgccugguccucuagcuccugccaugacggaaaagccuggcugcacguguguauuaccggcgaugacaagaacgcuaccgccagcuucaucuauaauggccggcuuguugauucuguggucuccuggagcaaagagauucugcgcacacaggaaucugagugcguguguaucaacgggacgugcaccguggucaugacagacggauccgcuagcggcaaggccgauaccaaaauucucuuuaucgaggaagggaagaucguucauacauccacccugucuggaagcgcgcaacacguggaggaaugcuccuguuacccuagauaucccgacgugcggugcgucugucgcgauaacuggaagggcagcaauagaccuauuguggacaucaacauuaaagaccacucuaucguuuccagcuacgugugcucugggcuugucggagauacgccccggaagaaugacagcuccucuagcucccauugucuggauccgaacaaugaggaaggcggccacggggugaaaggaugggccuucgacgauggcaacgacguuuggauggggcgcacaauuagcgagaagucuagacucggauacgagaccuuuaaagugaucgaaggcugguccaauccuaagagcaaacugcagaucaaccggcaggucauuguggaucgcgggaauagaucuggauauuccggcaucuucagcgucgagggcaaguccugcauuaaccgguguuuuuacguggaacugaucagagggcgcaaggaggaaaccgagguucucuggacaucuaauagcauuguggucuucugcggaaccuccggcacauaugggacgggaucuuggcccgacggcgcugauaucaaccugaugccuauuuga

SEQ ID NO: 203526 - RNA, 1395 nt, Artificial Sequence
  derived and/or modified sequence opt5 from neuraminidase__InfluenzaA__AEA04357
augaaccccaaucagaagaucauuaccaucggcagcauuugcaugguggucgggaucauuucccugauccuccaaaucggaaacauuguuucuaucuggauuagccacuccauccagacaggcaaucagaaccauacggggaccugugaccagucuauuaucacauacaaaaauagcaccugggugaaccaaacauaugugaaugucguggccggaaaggauaccacauccguuauucuggcuggcaacucuagccuuugcccuaucagagggugggccaucuacuccaaagacaauggagugcggauuggcagcaagggcgaugucuucgugauccgcgagccguuuauuucuuguucccaccuggaaugcagaaccuucuuucucacgcagggggcgcugcuuaacgacaaacauagcaauggaaccguuaaggaucggucucccuaucgcgcucugauguccuguccugugggcgaggcccccagcccuuacaacucuagauucgaauccgucgccuggagcgcuuccgccugccacgacgggaugggauggcucacaaucggcauuucugggcccgaugacggagcuguggccgugcugaaguauaauggcaucaucaccgagacaauuaaaagcuggcggaaggaaauccugcgcacccaggaguccgagugugucugcguuaacggcagcuguuuuacgauuaugacagaugggccuucuggaggcccggcguccuacaaaaucuucaagauugaaaaagggaaggugaccaagagcaucgagcucgacgcccccaauucucauuaugaagagugcagcuguuacccugauacauccaaagugaugugcgucugcagagacaacuggcacggaucuaaccggcccugggugagcuuugaucagaaucuggacuaccaaaugggcuauaucuguuccgggguuuucggagacaacccucgccccaaggauggcaaaggcagcugcgggccgguguacgucgacggagcuaauggcgugaagggguuuucuuauaaauacggaaacggcguuuggauugggagaaccaaguccaucagcucucggcagggcuucgagaugauuugggauccuaauggauggaccgaaacagacuccaacuuuuucacgaaacaggauguggucgccgugaccgacuggagcggcuauuccgggucuuuuguccagcaccccgagcuuacaggacuggauuguaugcgcccuugcuucuggguggaacucaucagaggccggcccaaggagaauaccauuuggacaagcggguccucuaucagcuucuguggaguuaacuccgacaccguggauuggagcuggcccgacggcgcugaacugccuuuuacgauugauaaguga

SEQ ID NO: 203527 - RNA, 1410 nt, Artificial Sequence; identical to SEQ ID NO: 199491
  derived and/or modified sequence opt5 from neuraminidase__InfluenzaA__AEA04368

SEQ ID NO: 203528 - RNA, 1410 nt, Artificial Sequence
  derived and/or modified sequence opt5 from neuraminidase__InfluenzaA__AEA04379
augaaccccaaucagaagaccaucacaauuggcagcgugucccugacgaucgagaccgucugcuuccucaugcaaauugccauccuggcuacaaccguuacacuucacuuuaaacagcaugaaugugacucuccugccagcaaccaggugaugccgugcgagcccauuaucaucgaaagaaauauuaccgagaucguguaccugaacaauacaaccauugaaaaggagaucuguccugaggucguggaauaucggaacugguccaaaccccagugccaaauuacgggguucgcgccuuuuucuaaggauaauagcauccgccucuccgcuggaggcgacauuuggguuaccagagagcccuacgugucuugugauccugggaaaugcuaucaguucgcccugggacagggcacaacccuugacaacaagcacagcaaugggacaauccaugaucggaucccgcaccgcacccugcucaugaacgaacugggaguccccuuucaucugggcacgaaacagguguguguugccugguccucuagcuccugccacgacggcaaggcuuggcuccacgugugugucacaggggaugacagaaaugccaccgcuagcuucauuuacgauggacggcugguggacucuaucggcuccuggagccaaaacauucuucgcacacaggagucugagugcguguguaucaaugggaccugcaccgucguuaugacagauggauccgccagcggcagagcggacacgcggauucuguuuaucaaggaagggaaaaucgugcauauuuccccucucucuggaagcgcccagcacaucgaggaaugcuccuguuauccccgcuacccugaugugagaugcauuugucgggacaacuggaagggcagcaaucgccccgucaucgacauuaacauggaggauuauucuaucgacuccagcuacgugugcucuggccugguuggggauaccccgagaaacgacgauagcuccucuaauagcaaaucccgggacccuaacaaugaacgcggaaaccccggcgugaaggggugggcuuucgauaauggagacgaugucuggaugggcagaacaaucagcaaggacucucgguccggguacgagaccuuuaaagugauuggaggcuggagcacaccuaacucuaagucccagguuaauagacaagugaucgucgauaacaauaacuggagcggcuauuccgggauuuucucuguggagggaaaaagcuguaucaaucgcugcuuuuacgucgaacuuauucggggcagaccccaggagacccgcgugugguggacguccaacucuaucguuguguucugugggacaagcggaaccuauggcaccggguccuggcccgacggcgccaauauuaacuuuaugccuaucuga

SEQ ID NO: 203529 - RNA, 1413 nt, Artificial Sequence; identical to SEQ ID NO: 203228
  derived and/or modified sequence opt5 from neuraminidase__InfluenzaA__AEA10295

SEQ ID NO: 203530 - RNA, 1410 nt, Artificial Sequence; identical to SEQ ID NO: 199762
  derived and/or modified sequence opt5 from neuraminidase__InfluenzaA__AEA10306

SEQ ID NO: 203531 - RNA, 1410 nt, Artificial Sequence; identical to SEQ ID NO: 203115
  derived and/or modified sequence opt5 from neuraminidase__InfluenzaA__AEA10316

SEQ ID NO: 203532 - RNA, 1410 nt, Artificial Sequence; identical to SEQ ID NO: 199762
  derived and/or modified sequence opt5 from neuraminidase__InfluenzaA__AEA10326

SEQ ID NO: 203533 - RNA, 1410 nt, Artificial Sequence; identical to SEQ ID NO: 201050
  derived and/or modified sequence opt5 from neuraminidase__InfluenzaA__AEA10335

SEQ ID NO: 203534 - RNA, 1410 nt, Artificial Sequence; identical to SEQ ID NO: 199762
  derived and/or modified sequence opt5 from neuraminidase__InfluenzaA__AEA10342

SEQ ID NO: 203535 - RNA, 1410 nt, Artificial Sequence
  derived and/or modified sequence opt5 from neuraminidase__InfluenzaA__AEA10352
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcauuaacggguccuguuucaccgugaugacggauggaccgagcgacggccaggccucuuacaaaaucuuucgcaucgaaaagggcaaaauugugaagucugucgagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcagcccggugucuuccaauggcgccaacggggucaagggauucagcuuuaaguauggcaacggcguguggaucgggagaacaaaauccauuucuagccggaauggauucgagaugaucugggauccuaacggcuggaccgggaccgacaauaacuuuuccaucaagcaagacauuguuggaaucaaugaauggucuggcuacagcggguccuucgugcagcaucccgagcuuacaggccuggauuguauucgcccuugcuucugggucgaacucaucagaggacggcccaaagagaacacgauuuggaccagcgggucuuccaucagcuuuuguggcgugaauagcgacacaguuggaugguccuggcccgauggcgcugagcugccuuucaccaucgacaaguga

SEQ ID NO: 203536 - RNA, 1410 nt, Artificial Sequence; identical to SEQ ID NO: 199762
  derived and/or modified sequence opt5 from neuraminidase__InfluenzaA__AEA48991

SEQ ID NO: 203537 - RNA, 1410 nt, Artificial Sequence; identical to SEQ ID NO: 202434
  derived and/or modified sequence opt5 from neuraminidase__InfluenzaA__AEA72707

SEQ ID NO: 203538 - RNA, 1410 nt, Artificial Sequence; identical to SEQ ID NO: 202434
  derived and/or modified sequence opt5 from neuraminidase__InfluenzaA__AEA72718

SEQ ID NO: 203539 - RNA, 1410 nt, Artificial Sequence; identical to SEQ ID NO: 202434
  derived and/or modified sequence opt5 from neuraminidase__InfluenzaA__AEA72729

SEQ ID NO: 203540 - RNA, 1410 nt, Artificial Sequence
  derived and/or modified sequence opt5 from neuraminidase__InfluenzaA__AEA72742
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaacggcuucgagaugaucugggauccuaauggguggaccggaaccgacaacaauuuuuccaucaagcaagacauuguuggcaucaacgaauggucuggguacagcggcuccuucgugcagcaucccgagcuuacaggacuggauuguauucgcccuugcuucugggucgaacucaucagaggccggcccaaagagaauacgauuuggaccagcgggucuuccaucagcuuuuguggagugaacucugacacaguuggcugguccuggcccgauggggcugagcugccuuucaccaucgacaaguga

SEQ ID NO: 203541 - RNA, 1410 nt, Artificial Sequence; identical to SEQ ID NO: 202037
  derived and/or modified sequence opt5 from neuraminidase__InfluenzaA__AEA72779

SEQ ID NO: 203542 - RNA, 1410 nt, Artificial Sequence
  derived and/or modified sequence opt5 from neuraminidase__InfluenzaA__AEA72789
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacgauuccaucagaaucgggagcaaaggagacguguuugucauucgggagccguucaucucuuguagcccccucgaaugccgcaccuuuuuccugacacagggcgcccuucugaaugauaagcauuccaacggcaccauuaaagacagaucuccuuaucggacgcucauguccugucccaucggggaggugccuagccccuacaauucccgcuuugaaucuguugccuggagcgcuuccgccugccacgauggaauuaacuggcugaccaucggcaucagcgggccugacaacggagcuguggccguccugaaguauaauggcauuaucacagauaccauuaagucuuggagaaacaauauccuccggacacaagaguccgagugugcgugcgugaacgggagcuguuucaccgugaugacggacggaccgucugauggccaggccagcuacaaaauuuuucgcaucgaaaagggcaaaaucgucaaguccguugagaugaaugcucccaacuaucauuacgaagagugcucuuguuacccugacagcuccgagauuacaugcgugugcagagauaauuggcacgggagcaaccggcccugggugucuuucaaucagaaccuggaauaucagaucggauacauuuguuccggcaucuuuggggacaauccucgccccaacgauaaaaccggaagcugcggcccggucucuuccaauggggccaacggagugaagggcuucagcuuuaaguauggcaaugggguuuggauuggaagaacaaaauccaucucuagccggaacggcuucgagaugauuugggacccuaacggguggaccggaaccgacaauaacuuuuccaucaagcaagauaucgugggcauuaaugaauggucuggguacagcggcuccuucguccagcaucccgagcuuacaggacuggacuguauccgcccuugcuucuggguggaacucauuagaggccggcccaaagagaacacgaucuggaccagcgggucuuccauuagcuuuuguggaguuaauucugauacagugggcugguccuggcccgacggggcugagcugccuuucaccaucgauaaguga

SEQ ID NO: 203543 - RNA, 1410 nt, Artificial Sequence; identical to SEQ ID NO: 202434
  derived and/or modified sequence opt5 from neuraminidase__InfluenzaA__AEA73291

SEQ ID NO: 203544 - RNA, 1410 nt, Artificial Sequence; identical to SEQ ID NO: 202434
  derived and/or modified sequence opt5 from neuraminidase__InfluenzaA__AEA73302

SEQ ID NO: 203545 - RNA, 1410 nt, Artificial Sequence; identical to SEQ ID NO: 202434
  derived and/or modified sequence opt5 from neuraminidase__InfluenzaA__AEA73313

SEQ ID NO: 203546 - RNA, 1410 nt, Artificial Sequence; identical to SEQ ID NO: 202434
  derived and/or modified sequence opt5 from neuraminidase__InfluenzaA__AEA73324

SEQ ID NO: 203547 - RNA, 1410 nt, Artificial Sequence; identical to SEQ ID NO: 202434
  derived and/or modified sequence opt5 from neuraminidase__InfluenzaA__AEA73335

SEQ ID NO: 203548 - RNA, 1410 nt, Artificial Sequence; identical to SEQ ID NO: 202434
  derived and/or modified sequence opt5 from neuraminidase__InfluenzaA__AEA73346

SEQ ID NO: 203549 - RNA, 1410 nt, Artificial Sequence; identical to SEQ ID NO: 202434
  derived and/or modified sequence opt5 from neuraminidase__InfluenzaA__AEA73357

SEQ ID NO: 203550 - RNA, 1410 nt, Artificial Sequence; identical to SEQ ID NO: 202434
  derived and/or modified sequence opt5 from neuraminidase__InfluenzaA__AEA73368

SEQ ID NO: 203551 - RNA, 1410 nt, Artificial Sequence; identical to SEQ ID NO: 202434
  derived and/or modified sequence opt5 from neuraminidase__InfluenzaA__AEA73379

SEQ ID NO: 203552 - RNA, 1410 nt, Artificial Sequence; identical to SEQ ID NO: 202434
  derived and/or modified sequence opt5 from neuraminidase__InfluenzaA__AEA73390

SEQ ID NO: 203553 - RNA, 1410 nt, Artificial Sequence; identical to SEQ ID NO: 202434
  derived and/or modified sequence opt5 from neuraminidase__InfluenzaA__AEA73401

SEQ ID NO: 203554 - RNA, 1410 nt, Artificial Sequence; identical to SEQ ID NO: 202434
  derived and/or modified sequence opt5 from neuraminidase__InfluenzaA__AEA73412

SEQ ID NO: 203555 - RNA, 1410 nt, Artificial Sequence; identical to SEQ ID NO: 202434
  derived and/or modified sequence opt5 from neuraminidase__InfluenzaA__AEA73423

SEQ ID NO: 203556 - RNA, 1410 nt, Artificial Sequence; identical to SEQ ID NO: 202434
  derived and/or modified sequence opt5 from neuraminidase__InfluenzaA__AEA73455

SEQ ID NO: 203557 - RNA, 1410 nt, Artificial Sequence; identical to SEQ ID NO: 202434
  derived and/or modified sequence opt5 from neuraminidase__InfluenzaA__AEA73466

SEQ ID NO: 203558 - RNA, 1410 nt, Artificial Sequence
  derived and/or modified sequence opt5 from neuraminidase__InfluenzaA__AEA73477
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccagcagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucaaugaaacaagcagacucggcuaugagaccuuuaaagugaucgagggguggucuaacccuaaguccaaacugcagauuaaucggcaggucaucguggaccgcggaaacagaagcggcuacucuggcauuuucuccgucgaagggaagucuuguaucaaucggugcuuuuauguggagcugauuagaggacgcaaggaagagaccaaaguucucuggacauccaacucuaucguggucuucuguggcaccagcgggacauacggaacgggcuccuggcccgauggggcugaccugaaucuuaugccuauuuga

SEQ ID NO: 203559 - RNA, 1410 nt, Artificial Sequence; identical to SEQ ID NO: 202434
  derived and/or modified sequence opt5 from neuraminidase__InfluenzaA__AEA73488

SEQ ID NO: 203560 - RNA, 1410 nt, Artificial Sequence
  derived and/or modified sequence opt5 from neuraminidase__InfluenzaA__AEA73499
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacaauuaauaacgugcauagcaauaacaccguucgggaucgcacgccguauagaacacugcucaugaaugagcugggcgugcccuuucaccuggggaccaaacaggucugcaucgccugguccagcagcuccugucaugacggaaaggccuggcuccacgugugcauuacaggcgaugacaaaaacgcuaccgccagcuucaucuacaauggccggcugguugauucuguggucuccuggagcaaggaaauucuucgcacccaggagucugaaugugugugcaucaacgggacauguacgguggucaugaccgacggauccgcuagcggcaaagccgauacaaagauccuguuuauugaggaggggaagaucguucauaccuccacacucucuggaagcgcgcaacacguggaagagugcuccugcuauccuagauaccccggcgugcggugugucugccgcgacaacuggaaagggagcaauagaccuauuguggauaucaacauuaaggaccacucuaucguuuccagcuacguguguucuggacuggucggcgacacgccccggaaaaaugauagcuccucuagcucccauugccuugacccgaacaaugaagagggcgggcacggagugaagggcugggccuucgaugacgggaacgauguuuggaugggacgcaccaucaaugaaacaagcagacugggcuaugagaccuuuaaagugauugagggguggucuaacccuaaguccaaacuccagaucaaucggcaggucauuguggaccgcggaaacagaagcggcuacucuggcaucuucuccgucgaagggaagucuuguauuaaucggugcuuuuauguggagcugaucagaggacgcaaggaagagaccgaaguucuguggacauccaacucuauuguggucuucuguggcaccagcgggacauacggaacgggcuccuggcccgauggggcugaccucaaucugaugccuaucuga

SEQ ID NO: 203561 - RNA, 1410 nt, Artificial Sequence; identical to SEQ ID NO: 202434
  derived and/or modified sequence opt5 from neuraminidase__InfluenzaA__AEA73510

SEQ ID NO: 203562 - RNA, 1410 nt, Artificial Sequence; identical to SEQ ID NO: 202434
  derived and/or modified sequence opt5 from neuraminidase__InfluenzaA__AEA73521

SEQ ID NO: 203563 - RNA, 1410 nt, Artificial Sequence; identical to SEQ ID NO: 202434
  derived and/or modified sequence opt5 from neuraminidase__InfluenzaA__AEA73532

SEQ ID NO: 203564 - RNA, 1410 nt, Artificial Sequence; identical to SEQ ID NO: 202434
  derived and/or modified sequence opt5 from neuraminidase__InfluenzaA__AEA73543

SEQ ID NO: 203565 - RNA, 1410 nt, Artificial Sequence; identical to SEQ ID NO: 202434
  derived and/or modified sequence opt5 from neuraminidase__InfluenzaA__AEA73554

SEQ ID NO: 203566 - RNA, 1410 nt, Artificial Sequence; identical to SEQ ID NO: 202434
  derived and/or modified sequence opt5 from neuraminidase__InfluenzaA__AEA73565

SEQ ID NO: 203567 - RNA, 1413 nt, Artificial Sequence; identical to SEQ ID NO: 200485
  derived and/or modified sequence opt5 from neuraminidase__InfluenzaA__AEA73576

SEQ ID NO: 203568 - RNA, 1413 nt, Artificial Sequence; identical to SEQ ID NO: 200485
  derived and/or modified sequence opt5 from neuraminidase__InfluenzaA__AEA73587

SEQ ID NO: 203569 - RNA, 1413 nt, Artificial Sequence; identical to SEQ ID NO: 203228
  derived and/or modified sequence opt5 from neuraminidase__InfluenzaA__AEA73598

SEQ ID NO: 203570 - RNA, 1413 nt, Artificial Sequence; identical to SEQ ID NO: 200485
  derived and/or modified sequence opt5 from neuraminidase__InfluenzaA__AEA73609

SEQ ID NO: 203571 - RNA, 1413 nt, Artificial Sequence; identical to SEQ ID NO: 200485
  derived and/or modified sequence opt5 from neuraminidase__InfluenzaA__AEA73620

SEQ ID NO: 203572 - RNA, 1413 nt, Artificial Sequence
  derived and/or modified sequence opt5 from neuraminidase__InfluenzaA__AEA73631
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggauuaaaagcaaccgccugagaaagggcuuugagaugaucugggaccccaauggguggacaaacacggacucugauuucuccgugaaacaggacguuguggcgaucaccgauuggagcggcuauuccggaucuuuuguccagcacccggaacucacaggccuggacugcauucggccuuguuucuggguggagcuuguucgcgggcugcccagagaaaacaccacaaucuggaccagcggauccucuauuagcuucugcggcgucaauuccgauacggccaacuggagcuggccugacggggcugagcuccccuuuacaaucgauaaguga

SEQ ID NO: 203573 - RNA, 1413 nt, Artificial Sequence
  derived and/or modified sequence opt5 from neuraminidase__InfluenzaA__AEA73642
augaaccccaaucagagaaucauuaccaucggcagcauuuccaucgccauugggaucaucucucugaugcuccaaauuggaaacaucauuagcaucugggcuucccacucuauucagacaggcagccagaauaacacggggaucugcaagcagcggauuaucaccuacgaaaauuccacaugggugaaccauaccuaugucaauaucaacaauacaaacguuguggccggagaggacaaaaccucugugacacuggcgggcaauagcucccuuuguagcauuucugggugggcuaucuacaccaaggauaacuccauucgcaucggaagcaaaggcgacgucuucgugauuagagagccuuuuaucucuugcucccaccuggaaugucggacguucuuucucacccaaggcgcccugcuuaaugauaagcauagcaacgggacagccaaagaccgcucuccguauagagcucugauguccugcccccucggagaggccccuagccccuacaauuccaaguucgaaucuguugcuuggagcgccuccgcgugucacgauggcaugggguggcugaccaucggaauuagcggcccugacaacggggccguggcuguccugaaguauaacggaaucauuacaggcaccaucaaaucuuggaagaaacagauucuccggacgcaggaguccgagugcguguguaugaauggcagcugcuuuacaaucaugaccgaugggcccucuaacaaggccgcuagcuacaaaaucuucaagauugaaaagggaaaaguuacaaaguccaucgagcugaaugccccuaacuuuuauuacgaagaguguucuugcuacccggacaccggcauugugaugugugucugccgcgauaauuggcaugggagcaacagacccuggguguccuucaaucagaaccuugacuaucaaaucggauacauuugcagcggcguguuuggggauaauccucggcccgaggacggagaaggcucuuguaacccugucaccguugauggcgcgaauggggugaaaggauucuccuauaaguacggcaacgggguguggcugggacgcacaaaaagcaauagacuccggaagggcuuugagaugaucugggaccccaacggguggacgaauaccgacucugauuucuccgucaaacaggacgugguugccauuacagauuggagcggcuauuccggaucuuuugugcagcacccggaacugaccggccuugacugcauccgcccuuguuucugggucgagcuggugagagggcucccccgggaaaacacaaccaucuggacgagcggauccucuauuagcuucugcggcguuaacuccgauacagcuaauuggagcuggccugacggggccgagcugcccuuuaccaucgauaaguga

SEQ ID NO: 203574 - RNA, 1413 nt, Artificial Sequence; identical to SEQ ID NO: 200485
  derived and/or modified sequence opt5 from neuraminidase__InfluenzaA__AEA73653

SEQ ID NO: 203575 - RNA, 1413 nt, Artificial Sequence
  derived and/or modified sequence opt5 from neuraminidase__InfluenzaA__AEA73664
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccgugaacggcgccgauggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcauccggccuuguuucuggguggagcuuguucgcgggcugcccaaggaaaacacaaccauuuggacgagcggauccucuaucagcuucugcggcgucaauuccgauacagccaacuggagcuggccugacggggcugagcuccccuuuaccauugauaaguga

SEQ ID NO: 203576 - RNA, 1413 nt, Artificial Sequence
  derived and/or modified sequence opt5 from neuraminidase__InfluenzaA__AEA73675
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccgacggggugaaaggauucuccuauaaguacggcaacggggucuggaucggacggacaaaaagcaaucgccugagaaagggcuuugagaugauuugggaccccaacggguggacgaauaccgauucugacuucuccgugaaacaggauguuguggcgaucacagacuggagcggcuauuccggaucuuuuguccagcacccggaacucaccggccuggauugcauccggccuuguuucuggauugagcuugugcgcgggcugcccagagaaaacacaaccaucuggacgagcggauccucuauuagcuucugcggcguuaacuccgacacagccaauuggagcuggccugauggggcugagcuccccuuuaccaucgacaaguga

SEQ ID NO: 203577 - RNA, 1413 nt, Artificial Sequence; identical to SEQ ID NO: 203228
  derived and/or modified sequence opt5 from neuraminidase__InfluenzaA__AEA73686

SEQ ID NO: 203578 - RNA, 1413 nt, Artificial Sequence
  derived and/or modified sequence opt5 from neuraminidase__InfluenzaA__AEA73697
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauauuguugccggagaagacaaaaccucugugacacuggcgggcaacagcucccuuuguagcaucucugggugggcuauuuacaccaaggauaauuccauccggauuggaagcaaaggcgacguguucgucauccgcgagccuuuuaucucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucuguugccuggagcgcuuccgccugucacgauggcaugggguggcugaccauuggaaucagcggcccugacaacggggcgguggccguccugaaguauaauggaauuaucacaggcaccauuaaaucuuggaagaaacagauccucagaacgcaggaguccgagugcguguguaugaacggcagcugcuuuacaaucaugaccgaugggcccucuaauaaggcugccagcuacaaaauuuucaagaucgaaaagggaaaaguuacaaaguccguggagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccgugaacggcgccgauggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcauccggccuuguuucuggguggagcuuguucgcgggcugcccagagaaaacacaaccauuuggacgagcggauccucuaucagcuucugcggcgucaauuccgauacagccaacuggagcuggccugacggggcugagcuccccuuuaccauugauaaguga

SEQ ID NO: 203579 - RNA, 1413 nt, Artificial Sequence; identical to SEQ ID NO: 203229
  derived and/or modified sequence opt5 from neuraminidase__InfluenzaA__AEA73708

SEQ ID NO: 203580 - RNA, 1413 nt, Artificial Sequence; identical to SEQ ID NO: 200485
  derived and/or modified sequence opt5 from neuraminidase__InfluenzaA__AEA73719

SEQ ID NO: 203581 - RNA, 1413 nt, Artificial Sequence; identical to SEQ ID NO: 200485
  derived and/or modified sequence opt5 from neuraminidase__InfluenzaA__AEA73730

SEQ ID NO: 203582 - RNA, 1413 nt, Artificial Sequence; identical to SEQ ID NO: 200485
  derived and/or modified sequence opt5 from neuraminidase__InfluenzaA__AEA73741

SEQ ID NO: 203583 - RNA, 1413 nt, Artificial Sequence; identical to SEQ ID NO: 200485
  derived and/or modified sequence opt5 from neuraminidase__InfluenzaA__AEA73752

SEQ ID NO: 203584 - RNA, 1413 nt, Artificial Sequence; identical to SEQ ID NO: 203228
  derived and/or modified sequence opt5 from neuraminidase__InfluenzaA__AEA73763

SEQ ID NO: 203585 - RNA, 1410 nt, Artificial Sequence; identical to SEQ ID NO: 199762
  derived and/or modified sequence opt5 from neuraminidase__InfluenzaA__AEA73774

SEQ ID NO: 203586 - RNA, 1410 nt, Artificial Sequence; identical to SEQ ID NO: 199762
  derived and/or modified sequence opt5 from neuraminidase__InfluenzaA__AEA73784

SEQ ID NO: 203587 - RNA, 1410 nt, Artificial Sequence; identical to SEQ ID NO: 199762
  derived and/or modified sequence opt5 from neuraminidase__InfluenzaA__AEA73794

SEQ ID NO: 203588 - RNA, 1410 nt, Artificial Sequence; identical to SEQ ID NO: 199762
  derived and/or modified sequence opt5 from neuraminidase__InfluenzaA__AEA73804

SEQ ID NO: 203589 - RNA, 1410 nt, Artificial Sequence; identical to SEQ ID NO: 199762
  derived and/or modified sequence opt5 from neuraminidase__InfluenzaA__AEA73814

SEQ ID NO: 203590 - RNA, 1410 nt, Artificial Sequence; identical to SEQ ID NO: 199762
  derived and/or modified sequence opt5 from neuraminidase__InfluenzaA__AEA73824

SEQ ID NO: 203591 - RNA, 1410 nt, Artificial Sequence
  derived and/or modified sequence opt5 from neuraminidase__InfluenzaA__AEA73834
augaaccccaaucagaagaucauuaccaucggcagcauuugcaugacaaucgggauggccaaccugauucuccaaaucggaaauaucauuuccaucuggauuucucacagcauccagcugggcaaccagaaucagauugagacguguaaccaauccgugaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggaaaaacaauauucucagaacacaagagucugagugugcgugcgucaacggguccuguuucaccgugaugacggauggaccgagcgacggccaggccucuuacaagaucuuucggaucgaaaaaggcaagauugugaaaagcgucgagaugaaugcucccaacuaucauuacgaagagugcuccuguuacccugauucuagcgagaucacaugcguuugccgcgacaauuggcacggguccaacagacccugggugagcuucaaucagaaccuggaauaucagauuggauacaucuguucuggcauuuuuggggauaauccucggcccaacgacaagaccggauccugcggcccggugagcucuaauggggccaacggagucaagggcuucuccuuuaaauauggcaacgggguguggaucggacgcacaaagagcauuuccucuagaaauggcuucgagaugaucugggauccuaacggguggaccggaaccgacaauaacuuuagcaucaaacaagacauuguuggcaucaaugaaugguccggguacucuggcagcuucgugcagcaucccgagcuuacaggacuggauuguauucggccuugcuucugggucgaacucauccgcggcagacccaaggagaacacgauuuggaccuccgggagcucuaucuccuuuuguggagugaauagcgacacaguuggcuggucuuggcccgauggggcugagcugccuuucaccaucgacaaauga

SEQ ID NO: 203592 - RNA, 1410 nt, Artificial Sequence; identical to SEQ ID NO: 203124
  derived and/or modified sequence opt5 from neuraminidase__InfluenzaA__AEA73844

SEQ ID NO: 203593 - RNA, 1410 nt, Artificial Sequence; identical to SEQ ID NO: 199762
  derived and/or modified sequence opt5 from neuraminidase__InfluenzaA__AEA73854

SEQ ID NO: 203594 - RNA, 1410 nt, Artificial Sequence; identical to SEQ ID NO: 199762
  derived and/or modified sequence opt5 from neuraminidase__InfluenzaA__AEA73864

SEQ ID NO: 203595 - RNA, 1410 nt, Artificial Sequence; identical to SEQ ID NO: 201543
  derived and/or modified sequence opt5 from neuraminidase__InfluenzaA__AEA73874

SEQ ID NO: 203596 - RNA, 1410 nt, Artificial Sequence; identical to SEQ ID NO: 201543
  derived and/or modified sequence opt5 from neuraminidase__InfluenzaA__AEA73884

SEQ ID NO: 203597 - RNA, 1410 nt, Artificial Sequence; identical to SEQ ID NO: 203124
  derived and/or modified sequence opt5 from neuraminidase__InfluenzaA__AEA73894

SEQ ID NO: 203598 - RNA, 1410 nt, Artificial Sequence
  derived and/or modified sequence opt5 from neuraminidase__InfluenzaA__AEA73904
augaaccccaaucagaagaucauuaccaucggcagcgugugcaugacaauugggauggccaaccugguccuccaaaucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucaucggcauuaaugaaugguccggguacucuggcagcuucguccagcaucccgagcuuacaggacuggauuguauccgcccuugcuucuggguggaacucauuagaggccggcccaaagagaagacgaucuggaccuccgggagcucuauuuccuuuuguggaguuaacagcgacacagugggcuggucuuggcccgauggggcugagcugccuuucaccaucgacaaauga

SEQ ID NO: 203599 - RNA, 1410 nt, Artificial Sequence; identical to SEQ ID NO: 199762
  derived and/or modified sequence opt5 from neuraminidase__InfluenzaA__AEA73914

SEQ ID NO: 203600 - RNA, 1410 nt, Artificial Sequence; identical to SEQ ID NO: 201543
  derived and/or modified sequence opt5 from neuraminidase__InfluenzaA__AEA73924

SEQ ID NO: 203601 - RNA, 1410 nt, Artificial Sequence; identical to SEQ ID NO: 203201
  derived and/or modified sequence opt5 from neuraminidase__InfluenzaA__AEA73934

SEQ ID NO: 203602 - RNA, 1410 nt, Artificial Sequence
  derived and/or modified sequence opt5 from neuraminidase__InfluenzaA__AEA73944
augaaccccaaucagaagaucauuaccaucggcagcgugugcaugacaauugggauggccaaccugauccuccaagucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuauuacuacgaagagugcuccuguuauccugauucuagcgagaucacaugcgugugcagagacaauuggcauggguccaaccggcccugggucagcuucaaucagaaccuggaauaccagauuggauauaucuguucuggcauuuuuggggauaauccucgccccaacgacaaaaccggauccugcggcccggugagcucuaauggggccaacggaguuaagggcuucuccuuuaaguacggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguauucuggcagcuucgugcagcaccccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 203603 - RNA, 1410 nt, Artificial Sequence; identical to SEQ ID NO: 199762
  derived and/or modified sequence opt5 from neuraminidase__InfluenzaA__AEA73954

SEQ ID NO: 203604 - RNA, 1410 nt, Artificial Sequence; identical to SEQ ID NO: 199762
  derived and/or modified sequence opt5 from neuraminidase__InfluenzaA__AEA73964

SEQ ID NO: 203605 - RNA, 1410 nt, Artificial Sequence
  derived and/or modified sequence opt5 from neuraminidase__InfluenzaA__AEA73974
augaaccccaaucagaagaucauuaccaucggcagcgugugcaugacaauugggauggccaaccugauccuccaaauuggaaauaucaucuccauuuggaucucucacagcauucagcauggcaaccagaaucagaucgagacguguaaccaauccgucauuaccuacgaaaauaacacauggguuaaucagaccuaugugaacaucucuaauacaaacuucgcugccgggcagagcguggucuccgugaaacuggcgggaaauucuagccuuugcccuguuuccggcugggcuauuuacagcaaggacaacucuaucagaaucggguccaaaggagauguguuugucauucgggagccguucaucagcuguucuccccuggaaugccgcaccuuuuuccucacacagggcgcccugcuuaaugacaagcacuccaacggcaccauuaaagauagaagcccuuaucggacgcugaugucuugucccaucggggaggugccuucccccuacaacagccgcuuugaauccguugccuggucugcuagcgccugccaugacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucacuacgaagagugcuccuguuacccugauucuagcgagauuacaugcgugugcagagacaauuggcauggguccaaccggcccugggugagcuucaaucagaaccucgaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaccccgagcugacaggacuugauuguauccgcccuugcuucuggguggaacugauuagaggccggcccaaagagaacacgaucuggaccuccgggagcucuauuuccuuuuguggaguuaauagcgacacagugggcuggucuuggcccgauggggcugagcucccuuucaccaucgacaaguga

SEQ ID NO: 203606 - RNA, 1410 nt, Artificial Sequence; identical to SEQ ID NO: 199762
  derived and/or modified sequence opt5 from neuraminidase__InfluenzaA__AEA73984

SEQ ID NO: 203607 - RNA, 1410 nt, Artificial Sequence; identical to SEQ ID NO: 201113
  derived and/or modified sequence opt5 from neuraminidase__InfluenzaA__AEA73994

SEQ ID NO: 203608 - RNA, 1410 nt, Artificial Sequence
  derived and/or modified sequence opt5 from neuraminidase__InfluenzaA__AEA74004
augaaccccaauaagaaaaucauuaucauuggcagcgugugcaugaccaucgggauggccaaccugauucuccagaucggaaauaucauuuccaucuggauuucucacagcauccaacugggcaaccagaaucagauugagacauguaaccaguccgucaucacguacgaaaauaacaccuggguuaaucaaacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaagggagauguguuugucauccgggagccguucauuagcuguucuccccucgaaugccgcacauuuuuccugacccagggcgcccuucugaaugacaaacauuccaacggcacaaucaaggauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaaaagcuggagaaacaauauucuccggacccaggagucugagugugcgugcgugaacggguccuguuucacagugaugaccgauggaccgagcgacggccaagccucuuacaagaucuuucgcaucgaaaaaggcaagauugucaaaagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaagacaggauccugcggcccggucagcucuaauggggccaacggagugaagggcuucuccuuuaaauauggcaacgggguuuggaucggaagaaccaagagcauuuccucucggaauggcuucgagaugaucugggauccuaacggguggacaggaaccgacaauaacuuuagcaucaaacaggacauugugggcaucaaugaaugguccggguacucuggcagcuucguccaacaucccgagcuuaccggacuggauuguauucgcccuugcuucuggguggaacucaucagaggccggcccaaggagaacacaauuuggacguccgggagcucuaucuccuuuuguggaguuaauagcgacaccgugggcuggucuuggcccgauggggcugagcugccuuucacaaucgacaaauga

SEQ ID NO: 203609 - RNA, 1410 nt, Artificial Sequence; identical to SEQ ID NO: 200939
  derived and/or modified sequence opt5 from neuraminidase__InfluenzaA__AEA74014

SEQ ID NO: 203610 - RNA, 1410 nt, Artificial Sequence; identical to SEQ ID NO: 200939
  derived and/or modified sequence opt5 from neuraminidase__InfluenzaA__AEA74024

SEQ ID NO: 203611 - RNA, 1410 nt, Artificial Sequence; identical to SEQ ID NO: 199762
  derived and/or modified sequence opt5 from neuraminidase__InfluenzaA__AEA74032

SEQ ID NO: 203612 - RNA, 1410 nt, Artificial Sequence; identical to SEQ ID NO: 199762
  derived and/or modified sequence opt5 from neuraminidase__InfluenzaA__AEA74034

SEQ ID NO: 203613 - RNA, 1410 nt, Artificial Sequence
  derived and/or modified sequence opt5 from neuraminidase__InfluenzaA__AEA77302
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaaaugcccuaagcucgcugaguaccggaauugguccaaaccccagugugacaucaccggguucgccccuuuuucuaaggauaacagcauucgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaaacaggucugcaucgccugguccucuagcuccugucaugacggaaaggccuggcugcacgugugcauuacaggcgaugacaaaaacgcuaccgccagcuucaucuacaauggccggcuuguugauucuguggucuccuggagcaaggagauucugcgcacccaggaaucugagugugugugcaucaacgggacauguacgguggucaugaccgacggauccgcuagcggcaaagccgauacaaagauucucuuuaucgaggaagggaagaucguucauaccuccacacugucuggaagcgcgcaacacguggaggaaugcuccugcuauccuagauaccccggcgugcggugugucugccgcgacaacuggaaagggagcaauagaccuauuguggauaucaacauuaaggaccacucuaucguuuccagcuacguguguucuggacuugucggcgacacccccaaaaagaaugauagcuccucuagcucccauugccuggacccgaacaaugaggaaggcgggcacggagugaaaggcugggccuucgaugacgggaacgauguuuggaugggacggacgauuagcgagaagucucgccucggcuaugagacauuuaaagugaucgaagggugguccaauccuaagagcaagcugcagaucaacagacaggucauuguggaccggggaaaucgcucuggcuacuccggcaucuucagcgucgaggggaaauccuguauuaacagaugcuuuuauguggaacugauccggggaagaaaggaggaaaccgagguucucuggaccucuaauagcauuguggucuucuguggcacauccgggaccuacggaacaggcucuuggcccgauggggcugacaucaaccugaugccuauuuga

SEQ ID NO: 203614 - RNA, 1410 nt, Artificial Sequence; identical to SEQ ID NO: 203281
  derived and/or modified sequence opt5 from neuraminidase__InfluenzaA__AEB21318

SEQ ID NO: 203615 - RNA, 1410 nt, Artificial Sequence
  derived and/or modified sequence opt5 from neuraminidase__InfluenzaA__AEB21328
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggauucaacuggcugaccauuggcaucagcgggccugauaauggagcuguggccguccugaaguauaacggcaucauuacagacaccaucaagucuuggagaaauaacauucuccggacacaagaguccgagugugcgugcgugaaugggagcuguuuuaccaucaugacggauggaccgucugacggccaggccagcuacaaaauuuuccgcaucgaaaagggcaaaaucgugaaguccgucgagaugaacgcucccaauuaucauuacgaagagugcucuuguuacccugauagcuccgagauuacaugcguuugcagagacaacuggcacgggagcaaucggcccugggugucuuuuaaccagaaucuggaauaucagaucggauacauuuguuccggcaucuucggggauaacccucgccccaaugacaaaaccggaagcugcggcccggugucuuccaacggggccaauggagucaagggcuuuagcuucaaguauggcaacgggguguggauuggaagaacaaaauccaucucuagccggaagggcuuugagaugauuugggauccuaacggguggaccggaaccgacaauaacuucuccaucaaacaagacaucguuggcauuaaugaauggucuggguacagcggcuccuucgugcagcaucccgagcuuacaggacuggauuguauccgcccuugcuuuugggucgaacucauuagaggccggcccaaggagaacacgaucuggaccagcgggucuuccaugagcuucuguggaguuaauucugacacagugggcugguccuggcccgauggggcugagcugccuuuuaccauugacaaauga

SEQ ID NO: 203616 - RNA, 1410 nt, Artificial Sequence; identical to SEQ ID NO: 203281
  derived and/or modified sequence opt5 from neuraminidase__InfluenzaA__AEB21340

SEQ ID NO: 203617 - RNA, 1410 nt, Artificial Sequence
  derived and/or modified sequence opt5 from neuraminidase__InfluenzaA__AEB21350
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguucccccagcgaaugccgcaccuuuuuccucacacagggcgcccugcuuaacgacaagcauucuaauggcaccauuaaagauagauccccuuaucggacgcugaugagcugucccaucggggaggugccuucccccuacaacucucgcuuugaaagcguugccugguccgcuagcgccugccacgacggaauuaacuggcucaccaucggcaucucugggccugauaauggagcuguggccguccugaaguauaacggcauuaucacagacaccauuaaguccuggagaaauaacauccugcggacacaagagagcgagugugcgugcgugaaugggucuuguuucaccauuaugacggauggaccgagcgacggccaggccuccuacaaaaucuuucgcaucgaaaagggcaaaauugugaagucugucgagaugaacgcucccaauuaucauuacgaagagugcagcuguuacccugauuccagcgagaucacaugcguuugcagagacaacuggcacgggucuaaucggcccuggguguccuucaaccagaaucucgaauaucagauuggauacaucuguagcggcauuuuuggggauaacccucgccccaaugacaaaaccggaucuugcggcccgguguccagcaacggggccaauggagucaagggcuucuccuuuaaguauggcaacgggguguggaucggaagaacaaaaucuauuaucagccggaagggcuucgagaugaucugggauccuaacggguggaccggaaccgacaauaacuuuuccauuaaacaagacaucguuggcauuaaugaauggucuggguacagcggcuccuucgugcagcaucccgagcugacaggacuugauuguauccgcccuugcuucugggucgaacugauuagaggccggcccaaggagaacacgaucuggaccagcgggucuuccaucagcuuuuguggaguuaauucugacacagugggcugguccuggcccgauggggcugagcucccuuucaccauugacaaauga

SEQ ID NO: 203618 - RNA, 1410 nt, Artificial Sequence; identical to SEQ ID NO: 203281
  derived and/or modified sequence opt5 from neuraminidase__InfluenzaA__AEB21360

SEQ ID NO: 203619 - RNA, 1410 nt, Artificial Sequence; identical to SEQ ID NO: 200629
  derived and/or modified sequence opt5 from neuraminidase__InfluenzaA__AEB40209

SEQ ID NO: 203620 - RNA, 1410 nt, Artificial Sequence; identical to SEQ ID NO: 199623
  derived and/or modified sequence opt5 from neuraminidase__InfluenzaA__AEB66898

SEQ ID NO: 203621 - RNA, 1413 nt, Artificial Sequence
  derived and/or modified sequence opt5 from neuraminidase__InfluenzaA__AEB71103
augaaccccaaucagaagaucauuaccaucggcagcgugucccuggggcucgucguuuucaacgugcugcuucacguggucucuauuaucgugacaguugugguccugggaaaugacggcgggaacggaauuugcaauggcacggugguuaaagaguacaacgaaaccgugagaaucgagcgggucauccaauggcauaauacaagcgugguggaauauauuccuuaccucaacgggggaaccuauacaaauaacaccgaguccgucugugauguuaagggcuuugccccguucucuaaagacaauggcgugcgcaucgggagcagaggacacguguuugucauucgggaacccuucguguccugcucuccucgcgaguguagaacauuuuuccugacccagggcagccuucugaacgauaagcauuccaaugggacgguuaaagaccggagccccuuuaagacccucaugucuguggaggucggacaguccccuaacguguaccaggcucgcuucgaagccguugcguggagcgcuacagccugccacgauggcaagaaauggaugaccaucggggugacaggacccgacucuaaggccgucgcugugguccauuauggcggcgugccuaccgauauuaucaauuccugggccggggacauucugagaacgcaagagagcucuuguacaugcauccagggagauuguuacuggguuaugaccgacggcccggcuaaccggcaggcccaguaucgcaucuacaaauccaaccaagggaagauuaucggacagauggauauuaauuuuaacggcgggcacaucgaagagugcagcuguuaccccaaugacggaaaaguggagugcgucuguagagauaacuggacaggcaccaaucggccugugcugguuauuucccccgaccucucuuauaaggugggcuaccugugcgcggggcuuccuagcgacacaccccgcggagaagaugcccaguucuccggcagcugcaccucuccggucgggggacagggcuauggggugaagggcuuuggauucagacaaggcaacgacguguggauggggcggacgaucucccgcaccagcagaucuggauuugagguuauccgggucaaaaauggcuggacacagaccagcaaggaacagauuagaaaacaagugguggucgauaaccugaauugguccggguacucuggcagcuucacacucccuaucgagcuguccggaaagagcugucuugugcccugcuucuggguugaaaccauucgcgggaaaccugaggagaagacgaucuggacaucuuccagcucuauugugauguguggcgucgacuaugaaguggcugauugguccuggcacgacggagccauccugcccuuugauaucgacaaaauguga

SEQ ID NO: 203622 - RNA, 1413 nt, Artificial Sequence; identical to SEQ ID NO: 201954
  derived and/or modified sequence opt5 from neuraminidase__InfluenzaA__AEB71899

SEQ ID NO: 203623 - RNA, 1410 nt, Artificial Sequence
  derived and/or modified sequence opt5 from neuraminidase__InfluenzaA__AEB71910
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacauacuucgcugccgggcagagcguggucuccgugaaacuugcgggaaacucuagccugugcccuguuuccggcugggcuauuuauagcaaggacaauucuaucagaaucggguccaaaggagauguguuugucauucgggagccguucaucagcuguucuccccucgaaugccgcaccuuuuuccugacacagggcgcccuucugaacgacaagcauuccaauggcaccauuaaagauagaagcccuuaccggacgcucaugucuugucccaucggggaggugccuucccccuauaacagccgcuuugaauccguugccuggucugcuagcgccugccacgacggaauuaacuggcugaccaucggcaucuccgggccugauaauggagcuguggccguccugaaguacaacggcauuaucacagacaccauuaagagcuggagaaauaacauccuccggacacaagagucugagugugcgugcgugaauggguccuguuucaccgugaugacggauggaccgagcgacggccaggccucuuauaaaauuuuucgcaucgaaaagggcaaaaucgucaagagcguugagaugaacgcucccaauuaccauuacgaagagugcuccuguuauccugauucuagcgagauuacaugcgugugcagagacaacuggcacggguccaaucggcccugggugagcuucaaccagaaucuggaauaccagaucggauauauuuguucuggcaucuuuggggauaacccucgccccaaugacaaaaccggauccugcggcccggucagcucuaacggggccaauggagugaagggcuucuccuuuaaguacggcaacgggguuuggauuggaagaacaaaaagcaucuccucucggaacggcuucgagaugauuugggauccuaauggguggaccggaaccgacaacaauuuuagcaucaagcaagacaucgugggcauuaacgaaugguccggguauucuggcagcuucguccagcaucccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 203624 - RNA, 1410 nt, Artificial Sequence; identical to SEQ ID NO: 199762
  derived and/or modified sequence opt5 from neuraminidase__InfluenzaA__AEB71919

SEQ ID NO: 203625 - RNA, 1410 nt, Artificial Sequence; identical to SEQ ID NO: 201508
  derived and/or modified sequence opt5 from neuraminidase__InfluenzaA__AEB71928

SEQ ID NO: 203626 - RNA, 1410 nt, Artificial Sequence
  derived and/or modified sequence opt5 from neuraminidase__InfluenzaA__AEB71939
augaaccccaaucagaagaucauuaccaucggcagcgugucccugacaauuucugccaucugcuucuuuaugcaaauugcuauccucaucacgaccgucacacugcacuucaaacaguacgaguuuaacagcccuccgaauaaccagguuaugcuuugugaacccaccauuaucgagagaaauauuacagaaaucguguaucugaccaacacaaccauugagaaggaaaucugcccuaaacucgccgaguaccggaauugguccaagccccagugugacauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaauaacacaguucgggaucgcaccccguauagaacgcuccugaugaaugaacugggcgugcccuuucaccucgggacaaagcaggucugcauugccugguccucuagcuccugucaugacggaaaggcuuggcugcacgugugcaucaccggcgaugacaaaaacgccacagcuagcuucauuuacaauggccggcuuguugauucuguggucuccuggagcaaagagauccugcgcacccaggaaucugagugugugugcauuaacgggaccuguacaguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucagcgagaagucuagacucggcuaugagacguuuaaagugaucgaagggugguccaaucauaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaacagagguucucuggaccucuaauagcaucguggucuucuguggcaccuccgggacauacggaaccggcucuuggccugauggggccgaccugaaccuuaugcccauuuga

SEQ ID NO: 203627 - RNA, 1410 nt, Artificial Sequence
  derived and/or modified sequence opt5 from neuraminidase__InfluenzaA__AEB71950
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgaucacggggugaaaggaugggccuucgacgauggcaacgacguuuggauggggcgcaccaucagcgagaagucuagacucggauaugagacauuuaaagugaucgaaggcugguccaaucauaagagcaaacugcagauuaaccggcaggucaucguggaucgcgggaauagaucuggauacuccggcauuuucagcgucgagggcaaguccuguaucaaccggugcuuuuauguggaacugauuagagggcgcaaggaggaaaccgagguucucuggaccucuaauagcaucguggucuucuguggaacauccggcaccuacgggacaggaucuuggccugacggcgcugaucugaaccuuaugcccauuuga

SEQ ID NO: 203628 - RNA, 1413 nt, Artificial Sequence; identical to SEQ ID NO: 202961
  derived and/or modified sequence opt5 from neuraminidase__InfluenzaA__AEB71961

SEQ ID NO: 203629 - RNA, 1410 nt, Artificial Sequence
  derived and/or modified sequence opt5 from neuraminidase__InfluenzaA__AEB71972
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugugaaggagaucugcccuaaacucgcugaauaccggaauugguccaagccccagugugacauuaccggguucgccccuuuuucuaaagauaacagcauccgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugagcugggcguccccuuucaccucgggaccaaacaggugugcauugccugguccucuagcuccugucaugacggaaaggccuggcugcacguuugcaucacaggcgaugacaagaacgcuaccgccagcuucauuuacaauggccggcuuguggauucugucguguccuggagcaaagaaauccugcgcacccaggagucugaaugugugugcauuaacgggacauguacggucguuaugaccgacggauccgcuagcggcaaggccgauacaaaaauccucuuuaucgaggaggggaagauugugcauaccuccacacugucuggaagcgcgcaacacguggaagagugcuccugcuauccuagauaccccggcguccggugugugugccgcgacaacuggaaggggagcaauagaccuaucguugauauuaacaucaaagaccacucuauuguguccagcuacgucuguucuggacuugugggcgacacgccccggaagaaugauagcuccucuagcucccauugccuggacccgaacaaugaagagggcgggcacggaguuaaaggcugggccuucgaugacgggaacgauguguggaugggacgcaccaucagcgaaaagucuagacucggcuaugagacauuuaaagucaucgaggggugguccaauccuaagagcaaacugcagauuaaccgccaggugaucgucgaccggggaaauagaucuggcuacuccggcauuuucagcguggaagggaaguccuguaucaaccggugcuuuuauguugagcugauuagaggacgcaaggaagagaccgaagugcucuggaccucuaauagcaucgucguguucuguggcacauccgggaccuacggaacaggcucuuggcccgauggggcugacauuaaccugaugccuaucuga

SEQ ID NO: 203630 - RNA, 1410 nt, Artificial Sequence
  derived and/or modified sequence opt5 from neuraminidase__InfluenzaA__AEB71983
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaugaaagaccacucuaucguuuccagcuacguguguucuggacuugucggcgacacgccccggcgcaaugauagcuccucuagcucccauugccuggacccgaacaaugaggaaggcgggcacggagugaagggcugggccuucgaugacgggaacgauguuuggaugggaagaaccauuagcgagaaaucucggcucggcuaugagacauuuaaggugaucgaagggugguccaauccuaaaagcaagcugcagaucaaccgccaggucauuguggacagaggaaaucggucuggcuacuccggcaucuucagcgucgaggggaaauccuguauuaacagaugcuuuuauguggaacugauccgcggacggaaggaggaaaccgagguucucuggaccucuaauagcauuguggucuucuguggcacauccgggaccuacggaacaggcucuuggcccgauggggcugacaucaaccugaugccuauuuga

SEQ ID NO: 203631 - RNA, 1413 nt, Artificial Sequence
  derived and/or modified sequence opt5 from neuraminidase__InfluenzaA__AEB71995
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuauaucaacauuaauaacacaaaugucguugccggagaagacaaaaccucugugacacuggcgggcaacagcucccuuuguagcaucucugggugggcuauuuacaccaaggauaauuccauccggauuggaagcaaaggcgacguguucgucauccgcgagccuuuuaucucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucuguugccuggagcgcuuccgccugucacgauggcaugggguggcugaccauuggaaucagcggcccugacaacggggcgguggccguccugaaguauaauggaauuaucacaggcaccauuaaaucuuggaagaaacagauccucagaacgcaggaguccgagugcguguguaugaacggcagcugcuuuacaaucaugaccgaugggcccucuaauaaggcugccagcuacaaaauuuucaagaucgaaaagggaaaaguuacaaaguccauugagcugaacgcuccuaauuuuuauuacgaagaguguucuugcuacccggacaccggcaucgugaugugugucugccgggauaacuggcaugggagcaaucgccccuggguguccuucaaccagaaucuugacuaucaaauuggauacaucugcagcggcguguuuggggauaacccuagacccgaggacggagaaggcucuuguaauccugucaccguuaacggcgccgauggggugaaaggauucuccuauaaguacggcaaugggguguggauuggacggacaaaaagcaaccgccugagaaagggcuuugagaugaucugggaccccaauggguggacgaacaccgacucugauuucuccgucaaacaggacgugguugcgaucacagauuggagcggcuauuccggaucuuuugugcagcacccggaacucaccggccuggagugcauucggccuuguuucugggucgaacuugugcgcgggcugcccagagagaacacaaccaucuggacgagcggauccucuauuagcuucugcggcguuaauuccgacacagccaacuggagcuggccugauggggcugagcuccccuuuaccaucgacaaguga

SEQ ID NO: 203632 - RNA, 1413 nt, Artificial Sequence; identical to SEQ ID NO: 203229
  derived and/or modified sequence opt5 from neuraminidase__InfluenzaA__AEC13316

SEQ ID NO: 203633 - RNA, 1410 nt, Artificial Sequence; identical to SEQ ID NO: 199762
  derived and/or modified sequence opt5 from neuraminidase__InfluenzaA__AEC53262

SEQ ID NO: 203634 - RNA, 1410 nt, Artificial Sequence; identical to SEQ ID NO: 199762
  derived and/or modified sequence opt5 from neuraminidase__InfluenzaA__AEC53272

SEQ ID NO: 203635 - RNA, 1410 nt, Artificial Sequence; identical to SEQ ID NO: 199762
  derived and/or modified sequence opt5 from neuraminidase__InfluenzaA__AEC53282

SEQ ID NO: 203636 - RNA, 1410 nt, Artificial Sequence; identical to SEQ ID NO: 199762
  derived and/or modified sequence opt5 from neuraminidase__InfluenzaA__AEC53292

SEQ ID NO: 203637 - RNA, 1410 nt, Artificial Sequence
  derived and/or modified sequence opt5 from neuraminidase__InfluenzaA__AEC53302
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacauuaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 203638 - RNA, 1410 nt, Artificial Sequence; identical to SEQ ID NO: 199762
  derived and/or modified sequence opt5 from neuraminidase__InfluenzaA__AEC53350

SEQ ID NO: 203639 - RNA, 1410 nt, Artificial Sequence; identical to SEQ ID NO: 200470
  derived and/or modified sequence opt5 from neuraminidase__InfluenzaA__AEC53407

SEQ ID NO: 203640 - RNA, 1410 nt, Artificial Sequence; identical to SEQ ID NO: 199762
  derived and/or modified sequence opt5 from neuraminidase__InfluenzaA__AEC53427

SEQ ID NO: 203641 - RNA, 1410 nt, Artificial Sequence; identical to SEQ ID NO: 200588
  derived and/or modified sequence opt5 from neuraminidase__InfluenzaA__AED99967

SEQ ID NO: 203642 - RNA, 1410 nt, Artificial Sequence; identical to SEQ ID NO: 199752
  derived and/or modified sequence opt5 from neuraminidase__InfluenzaA__AEE27161

SEQ ID NO: 203643 - RNA, 1410 nt, Artificial Sequence; identical to SEQ ID NO: 199762
  derived and/or modified sequence opt5 from neuraminidase__InfluenzaA__AEE27170

SEQ ID NO: 203644 - RNA, 1410 nt, Artificial Sequence; identical to SEQ ID NO: 199752
  derived and/or modified sequence opt5 from neuraminidase__InfluenzaA__AEE27180

SEQ ID NO: 203645 - RNA, 1410 nt, Artificial Sequence
  derived and/or modified sequence opt5 from neuraminidase__InfluenzaA__AEE27190
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcgugaucacagacaccauuaagagcuggagaaacaauauccuccggacacaagagucugagugugcgugcgucaacggguccuguuucaccguuaugacggauggaccgagcaauggccaggccucuuacaaaauuuuuaagaucgaaaaaggcaagauugugaaaagcguggagaugaacgcucccaauuaucauuacgaagagugcuccuguuacccugacucuagcgagaucacaugcgucugccgcgauaacuggcacggguccaauagacccugggugagcuucaaccagaaucuggaauaucagaucggauacauuuguucuggcaucuuuggggacaacccucggcccaaugauaagaccggauccugcggcccgguuagcucuaacggggccaacggagugaagggcuucuccuuuaaauauggcaauggggucuggauuggacgcacaaagagcaucuccucuagaaacggcuucgagaugauuugggacccuaauggguggaccggaaccgauaacaauuuuagcaucaaacaagacauugugggcaucaacgaaugguccggguacucuggcagcuucguucagcaucccgagcuuacaggacuggacuguauccggccuugcuucuggguggaacucauucgcggcagacccaaggagaauacgaucuggaccuccgggagcucuauuuccuuuuguggagucaacagcgauacagugggcuggucuuggcccgacggggcugagcugccuuucaccaucgauaaauga

SEQ ID NO: 203646 - RNA, 1410 nt, Artificial Sequence; identical to SEQ ID NO: 200985
  derived and/or modified sequence opt5 from neuraminidase__InfluenzaA__AEE27200

SEQ ID NO: 203647 - RNA, 1410 nt, Artificial Sequence; identical to SEQ ID NO: 202821
  derived and/or modified sequence opt5 from neuraminidase__InfluenzaA__AEG64755

SEQ ID NO: 203648 - RNA, 1362 nt, Artificial Sequence
  derived and/or modified sequence opt5 from neuraminidase__InfluenzaA__AEG64765
augaaccccaaucagaagaucauuaccaucggcagcauuugcaugguggucgggaucauuucccugauccuccaaaucggaaacauuaucucuauuuggaucagccacuccauucagacaggcaaucagaaccauacggggaucuguaaucagggaauuaucaccuacaacguuguggccggccaagacucuacaagcgugauccugaccggaaauuccucucuuugcccuauuagagggugggcuauccacagcaaagauaacggcauucggaucggcuccaagggggacgucuucgugauucgcgagccguuuaucagcuguucucaucuggaaugcagaacauucuuucucacccagggagcccugcuuaaugauaaacacuccaacggcacaguuaaggaccggagccccuaucgcgcgcugaugucuuguccugugggggaggcucccuccccuuacaauagcagauucgaaucugucgccugguccgccagcgcuugccaugauggaaugggcuggcucaccaucgggauuuccggacccgacaacggcgccguggcuguucugaaauauaauggcaucauuacggagaccaucaagucuuggcggaagaaaauucugcgcacacaggaaagcgaguguaccugcgugaacggguccuguuuuacaaucaugaccgauggaccuagcgacggccucgccucuuacaagaucuucaaaauugagaaggggaaagucacgaaguccaucgaacugaaugcgccgaacagccacuaugaggaaugcucuuguuaccccgauacaggaaaggugaugugcgugugcagagacaacuggcacggcagcaaucggccuugggucuccuuugaucagaaccuugacuaucaaauuggguacaucuguucuggaguuuucggcgauaauccccgcccuaaagacggcaccgggagcugcggacccguguccgccgacggcgcuaacggggugaagggauuuagcuacagauauggcaauggggucuggauuggccggacaaaaucugauuccagccgccauggauucgagaugaucugggacccgaacggcuggaccgagaccgauucuagauuuuccgugcggcaggacguuguggccaugacagaucgcagcggguacuccggaucuuucguccagcacccugaacugacgggccucgacuguaugagacccugcuuuuggguggagcugauucgggggagaccugaagagaagaccaucuggacaagcggauccaucauuucuuucuguggcguuaauagcgauaccguggacugguccuggcccgauggggcugaacuucccuucacaaucgacaaauga

SEQ ID NO: 203649 - RNA, 1410 nt, Artificial Sequence
  derived and/or modified sequence opt5 from neuraminidase__InfluenzaA__AEG64787
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaaucggcuccgcacacaagagucugagugugcgugcgugaacggguccuguuucaccgugaugacggauggaccgagcgacggccaggccucuuacaaaaucuuuagaauugaaaagggcaaaaucgucaagagcguugagaugaaugcucccaacuaucauuacgaagagugcuccuguuacccugauucuagcgagaucacaugcgugugccgggacaauuggcacggguccaaccgccccugggugagcuucaaucagaaccuggaauaucagauuggauacaucuguucuggcauuuuuggggauaauccuagacccaacgacaaaaccggauccugcggcccggucagcucuaauggggccaacggagugaagggcuucuccuuuaaguauggcaacgggguuuggaucggacggacaaaaagcauuuccucucgcaauggcuucgagaugaucugggauccuaacggguggaccggaaccgacaaugacuuuagcauuaagcaagauaucgugggcaucaacgaaugguccggguacucuggcagcuucguccagcaucccgagcuuacaggacuggacuguauuagaccuugcuucuggguggaacucauccggggccgccccaaagagaauacgauuuggaccuccgggagcucuaucuccuuuuguggaguuaacagcgauacagugggcuggucuuggcccgacggggcugagcugccuuucaccauugauaaguga

SEQ ID NO: 203650 - RNA, 1410 nt, Artificial Sequence
  derived and/or modified sequence opt5 from neuraminidase__InfluenzaA__AEG64837
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccuccucuuccugucaugacggaaaagccuggcugcacgugugcaucacaggcgaugacaagaacgcuaccgccagccuuauuuacaauggccggcugguugauucuguggucuccuggagcaaagagauccuccgcacccaggaaucugagugugugugcauuaacgggacauguacgguggucaugaccgacggauccgcuagcggcaaggccgauacaaaaauccuguucaucgaggaagggaagauuguucauaccuccacacuuucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuggucggcgacacgccccggaagaaugauagcuccucuagcucccauugccucgacccgaacaaugaggaaggcgggcacggagugaaaggcugggccuuugaugacgggaacgauguuuggaugggacgcaccaucaaugagacaagcagacugggcuaugagaccuucaaggugaucgaaggguggucuaacccuaaauccaagcugcagauuaaucggcaggucaucguggaccgcggaaacagaagcggcuacucuggcauuuuuagcgucgaggggaaaagcuguaucaaucggugcuucuauguggaacucauuagaggacgcaaggaggaaaccgagguucuguggacauccaacucuaucguggucuuuuguggcaccagcgggacauacggaacgggcuccuggcccgauggggcugaccuuaaucugaugccuauuuga

SEQ ID NO: 203651 - RNA, 1410 nt, Artificial Sequence
  derived and/or modified sequence opt5 from neuraminidase__InfluenzaA__AEG64848
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacuggcugaagccccagugugacauuaccggguucgccccuuuuuccaaagauaauucuauccgccuuagcgcgggaggcgacaucugggugacaagagagcccuacgucuccugcgauccugacaaguguuaucaauucgcucuggggcagggaaccacacucaacaaugugcauucuaacaauaccguucgggaucgcacgccguacagaacacugcugaugaacgaacucggcgugcccuuucaccuggggaccaagcaggucugcauugccuggagcuccagcucuugucaugacggaaaagccuggcuucacgugugcaucacaggcgaugacaagaaugcuaccgccuccuucauuuauaacggccggcugguugauagcguggucucuugguccaaagagauccuccgcacccaggaaagcgagugugugugcauuaaugggacauguacgguggucaugaccgacggaucugcuuccggcaaggccgauacaaaaauccuguuuaucgaggaagggaagauuguucauaccagcacacuuuccggaucugcgcaacacguggaggaaugcagcugcuacccuagauaccccggcgugcggugugucugccgcgacaacuggaagggguccaacagaccuaucguggauauuaauaucaaagaccacagcauuguuucuuccuauguguguagcggacuggucggcgacacgccccggaagaacgauucuagcuccucuagccauugccucgacccgaauaacgaggaaggcgggcacggagugaaaggcugggccuucgaugacgggaaugauguuuggaugggacgcaccaucaacgagacauccagacugggcuacgagaccuuuaaggugaucgaaggguggagcaauccuaaaucuaagcugcagauuaacaaacaggucaucguggaccggggaaaucgcuccggcuauagcggcauuuucucugucgaggggaaguccuguaucaacagaugcuuuuacguggaacucauucggggaagaaaggaggaaaccgagguucuguggacaagcaauuccaucguggucuucuguggcaccucugggacauauggaacgggcagcuggcccgauggggcugaccuuaaccugaugccuauuuga

SEQ ID NO: 203652 - RNA, 1410 nt, Artificial Sequence; identical to SEQ ID NO: 197257
  derived and/or modified sequence opt5 from neuraminidase__InfluenzaA__AEG64859

SEQ ID NO: 203653 - RNA, 1410 nt, Artificial Sequence; identical to SEQ ID NO: 197085
  derived and/or modified sequence opt5 from neuraminidase__InfluenzaA__AEG64870

SEQ ID NO: 203654 - RNA, 1410 nt, Artificial Sequence; identical to SEQ ID NO: 197277
  derived and/or modified sequence opt5 from neuraminidase__InfluenzaA__AEG64881

SEQ ID NO: 203655 - RNA, 1410 nt, Artificial Sequence; identical to SEQ ID NO: 197085
  derived and/or modified sequence opt5 from neuraminidase__InfluenzaA__AEG64892

SEQ ID NO: 203656 - RNA, 1410 nt, Artificial Sequence; identical to SEQ ID NO: 197161
  derived and/or modified sequence opt5 from neuraminidase__InfluenzaA__AEG64914

SEQ ID NO: 203657 - RNA, 1410 nt, Artificial Sequence; identical to SEQ ID NO: 197161
  derived and/or modified sequence opt5 from neuraminidase__InfluenzaA__AEG64925

SEQ ID NO: 203658 - RNA, 1410 nt, Artificial Sequence
  derived and/or modified sequence opt5 from neuraminidase__InfluenzaA__AEG64936
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaggauaaaaacgccaccgcuuccuucauuuauaaugggcggcugguggacagcaucggaucuugguccaagaaaauucuccgcacccaggaaagcgagugcgucuguaucaacggcacaugcacgguggugaugaccgaugggucugccuccggaaaggcggacacaaaaauucuguuuaucgaggaaggcaagaucguccacauuagcacccuuuccgggucugcccaacauguugaggaaugcagcuguuacccuagauaucccggagugcggugcgugugucgcgauaacuggaagggcuccaauagaccuaucgucgacauuaacgugaaagauuacagcaucguuucuuccuacgugugcagcggccuggucggggacacaccccggaagaaugacucuagcuccucuagccacugucucgauccgaacaaugaggaaggaggccauggggugaaaggaugggcuuucgacgauggcaacgacguuuggauggggcgcaccauuuccgagaagcugagaagcggauaugagacguuuaaagugaucgaaggcuggucuaagccuaauuccaaacugcagaucaaccggcaggucauuguggagcgcggcaauagaagcggguacucuggaaucuucuccgucgaaggcaagagcugcauuaaccgguguuuuuauguggagcucaucagagggcgcaaggaagagacagagguuugguggaccuccaauucuauuguggucuucugcggaaccagcggcacauacgggaccggcuccuggcccgauggagccgacaucaaccugaugccuauuuga

SEQ ID NO: 203659 - RNA, 1410 nt, Artificial Sequence; identical to SEQ ID NO: 197174
  derived and/or modified sequence opt5 from neuraminidase__InfluenzaA__AEG64947

SEQ ID NO: 203660 - RNA, 1410 nt, Artificial Sequence; identical to SEQ ID NO: 197161
  derived and/or modified sequence opt5 from neuraminidase__InfluenzaA__AEG64958

SEQ ID NO: 203661 - RNA, 1410 nt, Artificial Sequence; identical to SEQ ID NO: 197161
  derived and/or modified sequence opt5 from neuraminidase__InfluenzaA__AEG64969

SEQ ID NO: 203662 - RNA, 1410 nt, Artificial Sequence; identical to SEQ ID NO: 197161
  derived and/or modified sequence opt5 from neuraminidase__InfluenzaA__AEG64980

SEQ ID NO: 203663 - RNA, 1410 nt, Artificial Sequence
  derived and/or modified sequence opt5 from neuraminidase__InfluenzaA__AEG64991
augaaccccaaucagaagaucauuaccaucggcagcgugucccugacaauuucuacgaucugcuucuuuaugcaaauugccauccucaucaccacagucacccugcacuucaaacaguacgagagcaacuccccuccgaauaaccagguuaugcuuugugaacccacaauuaucgagagaaauauuaccgaaaucguguaucugacaaacaccacgauugagaaggaaaucugcccuaaacucgcugaguaccggaauuggucuaagccccaguguaacauuaccggguuugccccuuucagcaaagacaauuccauccgccugucugcgggaggcgauaucugggugacaagagagcccuaugucagcugcgacccugauaaguguuaccaauuugcucuugggcagggaaccacacugaacaaugugcauuccaacgacaccguucacgaucggacgccguaucgcacacuccugaugaaugaacugggcgugcccuuccaucucgggaccaagcaggucugcauugccuggucuagcuccagcugucacgacggaaaagccuggcugcaugugugcguuacaggcgaugacaagaacgcuaccgccucuuuuaucuacaauggcagacuuguggauuccauugucagcuggucuaaagagauccugcggacccaggaauccgagugugugugcauuaacgggacauguacgguggucaugaccgacggaagcgcuuccggcaaggccgauacaaaaauccucuucaucgaggaagggaagauuguucacaccucuacacugagcggauccgcgcaacacguggaggaaugcagcugcuauccucgcuaccccggcgugagaugugucugccgggacaacuggaaggggucuaaucgcccuaucguggauauuaacaucaaagacuacuccauuguuagcucuuauguguguagcggacuugucggcgacacccccagaaagaaugauuccucuagcuccagccauugccuggacccgaacaaugaggaaggcgggcacggagugaaaggcugggccuuugaugacgggaacgauguuuggaugggacggacgaucucugagaagcuccgcuccggcuacgagacauucaaagugaucgaaggguggagcaauccuaacucuaagcugcagaccaauagacaggucauuguggaccggggaaaccgcuccggcuauagcggcaucuuuuccgucgaggggaaaucuuguauuaauagaugcuucuacguggaacugauccggggaagaaaggaggaaaccgagguucucuggacaagcaacuccauuguggucuuuuguggcaccucugggacauauggaacgggcagcuggcccgauggggcugacaucaaucugaugccuauuuga

SEQ ID NO: 203664 - RNA, 1410 nt, Artificial Sequence; identical to SEQ ID NO: 197351
  derived and/or modified sequence opt5 from neuraminidase__InfluenzaA__AEG65002

SEQ ID NO: 203665 - RNA, 1410 nt, Artificial Sequence
  derived and/or modified sequence opt5 from neuraminidase__InfluenzaA__AEG65013
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagauauccugcggacccaggagucugaaugugugugcauuaaugggacauguacgguggucaugaccgacggauccgcuagcggcaaggccgauacaaaaauccucuuuaucgaggaggggaagauuguucacaccuccacacugucuggaagcgcgcaacacguggaagagugcuccugcuauccucgcuaccccggcgugagaugugucugccgggacaacuggaaggggagcaaccgcccuaucguggacauuaauaucaaagauuacucuauuguuuccagcuauguguguucuggacuugucggcgacacccccagaaagaacgauagcuccucuagcucccauugccuggacccgaauaacgaagagggcgggcacggagugaaaggcugggccuucgaugacgggaaugauguuuggaugggacggacgaucagcgaaaagcuccgccugggcuacgagacauuuaaagugaucgagggguggucuaacccuaauuccaagcugcagaccaacagacaggucauuguggaacggggaaaucgcagcggcuauucuggcaucuucuccgucgaggggaaaagcuguauuaacagaugcuuuuacguggaacucauccggggaagaaaggaggaaaccgagguucuguggacauccaauucuauuguggucuucuguggcaccagcgggacauauggaacgggcuccuggcccgacggggcugauaucaaccuuaugccuauuuga

SEQ ID NO: 203666 - RNA, 1410 nt, Artificial Sequence
  derived and/or modified sequence opt5 from neuraminidase__InfluenzaA__AEG65024
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccauguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaguucgcucuugggcaaggaaccacacugaauaacgugcacagcaaugauaccguucaugaccggacgccguaucgcacacuccugaugaacgaacugggcgugcccuuucaccucgggaccaagcaggucugcauugccugguccucuagcuccugucaugauggaaaagccuggcugcacgugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcagcauguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccacugccuggauccgaauaacgaggaaggcgggcauggagugaaaggcugggccuucgacgaugggaaugacguuuggaugggacggacgaucagcgagaagcuccgccugggcuacgagacauuuaaagugaucgaaggguggucuaacccuaauuccaagcugcaaauuaacagacaggucaucguggaucggggaaaucgcagcggcuauucuggcauuuucuccgucgaggggaaaagcuguaucaacagaugcuuuuacguggaacucauucggggaagaaaggaggaaaccgagguucuguggaccuccaauucuaucguggucuucuguggcacaagcgggaccuauggaacaggcuccuggcccgacggggcugauauuaaccuuaugccuaucuga

SEQ ID NO: 203667 - RNA, 1410 nt, Artificial Sequence
  derived and/or modified sequence opt5 from neuraminidase__InfluenzaA__AEG65035
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaagugugcccuaaacucgcugaguaccggaauugguccaagccccaguguaacaucaccggguucgccccuuuuucuaaagacaauagcauucgccuguccgcgggaggcgauaucugggucacaagagagcccuaugugucuugcgaccuugauaaguguuaccaauucgcucuggggcagggaaccacacucaacaauguucauagcaacgacaccgugcacgaucggacgccuuaucgcacacugcugaugaaugaacucggcgucccguuucaucuggggaccaaacaggugugcaucgccugguccucuagcuccugucacgacggaaaggccuggcuucauguuugcgugacaggcgaugacaagaacgcuaccgccagcuucauuuacaauggcagacuggucgauucuaucguguccuggagcaaagagauucuccggacccaggaaucugagugugugugcaucaacgggacauguacggucguuaugaccgacggauccgcuagcggcaaggccgauacaaaaauucuguuuaucgaggaagggaagaucgugcacaccuccacacuuucuggaagcgcgcaacacguggaggaaugcuccugcuauccccgcuacccuggcgucagaugugugugccgggacaacuggaaggggagcaaucgccccauuguugauaucaacauuaaagacuacucuaucguguccagcuaugucuguucuggacuggugggcgacaccccuagaaagaaugauagcuccucuagcucccauugccucgaccccaacaaugaggaaggcgggcacggaguuaaaggcugggccuucgaugacgggaacgauguguggaugggacggacgauuagcgagaagcugcgcucuggcuacgagacauuuaaagucaucgaagggugguccaauccgaacagcaagcugcagaucaauagacaggugauugucgaccggggaaaccgcucuggcuauuccggcaucuucagcguggaggggaaauccuguauuaauagaugcuuuuacguugaacucauccggggaagaaaggaggaaaacgaggugcuguggaccucuaauagcauugucguguucuguggcaccuccgggacauauggaaccggcucuuggccugauggggcugacaucaaccuuaugcccauuuga

SEQ ID NO: 203668 - RNA, 1410 nt, Artificial Sequence; identical to SEQ ID NO: 197736
  derived and/or modified sequence opt5 from neuraminidase__InfluenzaA__AEG65057

SEQ ID NO: 203669 - RNA, 1410 nt, Artificial Sequence; identical to SEQ ID NO: 198731
  derived and/or modified sequence opt5 from neuraminidase__InfluenzaA__AEG65068

SEQ ID NO: 203670 - RNA, 1410 nt, Artificial Sequence
  derived and/or modified sequence opt5 from neuraminidase__InfluenzaA__AEG65079
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgaagcacguggaggaaugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcggccauugccuggacccgaacaaugaggaagggggacacggcgugaaagggugggccuucgaugacggaaacgauguuuggaugggccggacgaucuccgagaaacuccgcagcggguacgagacauuuaaggugaucgaaggauggucuaauccuaacuccaaacugcaaauuaauagacaggucaucguggaccggggcaaccgcagcggcuauucugggauuuucuccgucgagggaaagagcuguaucaauagaugcuuuuacguggaacugauucggggcagaaaggaggaaaccgagguucucuggaccuccaacucuaucguggucuucugugggacaagcggaaccuauggcacaggguccuggcccgauggcgcugacauuaaucugaugccuaucuga

SEQ ID NO: 203671 - RNA, 1410 nt, Artificial Sequence
  derived and/or modified sequence opt5 from neuraminidase__InfluenzaA__AEG65090
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuauccacaccuccacacugucuggaagcgcgcaacacguugaggaaugcuccugcuauccucgcuaccccggcgugagaugugugugccgggacaacuggaaggggagcaaucgcccuauugucgauaucaacauuaaagacuacucuaucguguccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgaucagcgagaagcuccgcucuggcuacgagacauuuaaaguuauugaagggugguccaauccuaacagcaagcugcagaucaauagacaggugauugucgaccggggaaaccgcucuggcuauuccggcaucuucagcguggaggggaaauccuguauuaauagaugcuuuuacgucgaacugauccggggaagaaaggaggaaaccgaggugcucuggaccucuaacagcauuguuguguucuguggcacauccgggaccuauggaacaggcucuuggcccgauggggcugacaucagccugaugccuaucuga

SEQ ID NO: 203672 - RNA, 1410 nt, Artificial Sequence
  derived and/or modified sequence opt5 from neuraminidase__InfluenzaA__AEG65101
augaaccccaaucagaagaucauuaccaucggcagcgugucccugacaauuucuacgaucugcuucuuuaugcaaauugccauccucaucaccacagucacccugcacuucaaacaguacgaguuuaacagcccuccggacaaucagguuaugcuuugugaacccacaauuaucgagagaaacauuaccgaaaucguguaucugacaaauaccacgauugagaaggaaaucugcccuaaacucgcugaguaccggaacugguccaagccccagugugauauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucugucguguccuggagcaaagacauucugcggacccaggagucugaaugugugugcaucaacgggacauguacggucguuaugaccgauggauccgcuagcggcaaggccgacacaaaaauucucuuuaucgaggaggggaagaucgugcacaccuccacacugucuggaagcgcgcaacacguggaagagugcuccugcuauccucgcuaccccggcgucagaugugugugccgggacaauuggaaggggagcaaccgcccuauuguugauaucaacauuaaaaauuacucuaucguguccagcuaugucuguucuggacuugugggcgacacccccagaaagacggauagcuccucuagcucccauugccuggacccgaacaaugaagagggcgggcacggaguuaaaggcugggccuucgaugacgggaacgauguguggaugggacggacaauuagcgaaaagcuccgccugggcuacgagaccuuuaaagucaucgagggguggucuaauccuaacuccaagcugcagaucaauagacaggugauugucgaccggggaaaccgcagcggcuauucuggcaucuucuccguggaagggaaaagcuguauuaauagaugcuuuuacguugagcucauccggggaagaaaggaagagaccgaagugcuguggacauccaacucuauugucguguucuguggcaccagcgggacauauggaacgggcuccuggcccgauggggcugacaucaaucuuaugccuauuuga

SEQ ID NO: 203673 - RNA, 1410 nt, Artificial Sequence
  derived and/or modified sequence opt5 from neuraminidase__InfluenzaA__AEG65123
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaaccauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucacgaccggacaccguaucgcacccuccugaugaacgaacugggcgugcccuuucaucucgggacaaagcaggucugcaucgccugguccucuagcuccugucacgauggaaaagccuggcugcaugugugcguuaccggcgacgauaagaaugcuaccgccagcuucauuuacaacggcagacuuguggacucugucguguccuggagcaaagauauccugcggacacaggagucugaaugugugugcauuaaugggacguguaccgucguuaugacagacggauccgcuagcggcaaggccgauaccaaaauccucuuuauugaggaggggaagaucgugcacacauccacccugucuggaagcgcgcaacacguggaagagugcuccugcuauccucgcuaccccggcgucagaugugugugccgggacaacuggaaggggagcaaccgcccuaucguugacauuaauaucaaaaacuacucuauuguguccagcuaugucuguucuggacuugugggcgauacgcccagaaagacagacagcuccucuagcucccauugccuggauccgaauaacgaagagggcgggcacggaguuaaaggcugggccuucgacgaugggaaugacguguggaugggacggaccaucagcgaaaagcuccgccugggcuacgagaccuuuaaagucauugagggguggucuaacccuaauuccaagcugcagaucaacagacaggugaucgucgaucggggaaaucgcagcggcuauucuggcauuuucuccguggaagggaaaagcuguaucaacagaugcuuuuacguugagcucauucggggaagaaaggaagagaaugaagugcuguggacauccaacucuaucgucguguucuguggcaccagcgggacauauggaacgggcuccuggcccgacggggcugauauuaaucuuaugccuaucuga

SEQ ID NO: 203674 - RNA, 1410 nt, Artificial Sequence; identical to SEQ ID NO: 198731
  derived and/or modified sequence opt5 from neuraminidase__InfluenzaA__AEG65134

SEQ ID NO: 203675 - RNA, 1410 nt, Artificial Sequence
  derived and/or modified sequence opt5 from neuraminidase__InfluenzaA__AEG65145
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcaacucccauugucucgacccgaauaacgaggaaggaggccacggggugaagggaugggcuuuugaugacggcaaugauguuuggauggggcgcaccauuucugagaaacugagaagcggauacgagacguucaaggugaucgaaggcugguccaaaccuaacagcaagcugcagaucaaucggcaggucauuguggagcgcggcaacagaucuggguauuccggaaucuuuagcgucgaaggcaaaucuugcauuaaucgguguuucuacguggagcucaucagagggcgcaaggaagagacagagguuugguggaccuccaacagcauuguggucuuuugcggaaccuccggcacauaugggaccggcucuuggcccgacggagccgauaucaaucugaugccuauuuga

SEQ ID NO: 203676 - RNA, 1410 nt, Artificial Sequence
  derived and/or modified sequence opt5 from neuraminidase__InfluenzaA__AEG65156
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacaccagcacacuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacgccccggaaaaaugauucuuucagcuccucucauugucucgacccgaacaaugaggaaggaggccacggggugaagggaugggcuuuugaugacggcaacgauguuuggauggggcgcaccaucagcgagaaacugagauccggauacgagacauucaaggugauugaaggcuggagcaaaccuaauucuaagcugcagaucaaccggcaggucaucguggagcgcggcaauagauccggguauagcggaaucuuuucugucgaaggcaaauccugcauuaaccgguguuucuacguggagcucauuagagggcgcaaggaagagaccgagguuugguggaccagcaauuccaucguggucuuuugcggaacaucuggcaccuaugggacaggcagcuggcccgacggagccgauauuaaccugaugccuaucuga

SEQ ID NO: 203677 - RNA, 1410 nt, Artificial Sequence
  derived and/or modified sequence opt5 from neuraminidase__InfluenzaA__AEG65167
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugccagacacguugaggaaugcagcuguuauccucgguaccccggagugcgcugcguguguagagacaacuggaagggcuccaaucggccuaucgucgauauuaacgugaaggacuacagcaucguuucuuccuaugugugcagcggccuggucggggacacaccccgcaaaaaugauucuuucagcuccucucauugucucgacccgaacaaugaggaaggaggccacggggugaagggaugggcuuuugaugacggcaacgauguuuggauggggagaaccauuagcgagaaacugcgguccggauacgagacguucaaggugaucgaaggcuggagcaaaccuaauucuaagcugcaaaucaaccgccaggucauuguggagagaggcaaucgguccggguauagcggaaucuuuucugucgaaggcaaauccugcauuaacagauguuucuacguggagcucauccgcgggcggaaggaagagacagagguuugguggaccagcaauuccauuguggucuuuugcggaaccucuggcacauaugggaccggcagcuggcccgacggagccgauaucaaccugaugccuauuuga

SEQ ID NO: 203678 - RNA, 1410 nt, Artificial Sequence
  derived and/or modified sequence opt5 from neuraminidase__InfluenzaA__AEG65178
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacaauaccguucaugaccggacgccguaccgcacacugcugaugaacgaacucggggugcccuuucaccugggaaccagacaggucuguaucgccuggagcuccagcucuugccaugauggcaaggcuuggcuucacguguguguuacaggcgacgauaaaaaugccaccgcuuccuucauuuauaacgggcggcugguggacagcaucggaucuugguccaagaacauucuccgcacccaggagagcgaaugcgucuguaucaauggcacaugcacgguggugaugaccgaugggucugccuccggaaaagcggacacaaagauucuguuuaucgaggagggcaaaaucguccacauuagcacccuuuccgggucugcccaacauguugaagagugcagcuguuacccuagauaucccggagugcggugcgugugucgcgauaacuggaagggcuccaauagaccuaucgucgacauuaacgugaaggauuacagcaucguuucuuccuacgugugcagcggccuggucggggacacaccccggaaaaaugacucuuucagcuccucucacugucucgauccgaacaaugaagagggaggccauggggugaagggaugggcuuuugacgauggcaacgacguuuggauggggcgcaccauuagcgaaaaacugagauccggauaugagacguucaaggugaucgagggcuggagcaaaccuaauucuaagcugcagaucaaccggcaggucauuguggaacgcggcaauagauccggguacagcggaaucuuuucugucgagggcaaauccugcauuaaccgguguuucuauguggaacucaucagagggcgcaaggaggaaacagagguuugguggaccagcaauuccauuguggucuuuugcggaaccucuggcacauacgggaccggcagcuggcccgauggagccgacaucaaccugaugccuauuuga

SEQ ID NO: 203679 - RNA, 1410 nt, Artificial Sequence
  derived and/or modified sequence opt5 from neuraminidase__InfluenzaA__AEG65189
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaacgacuacucuauuguuuccagcuauguguguucuggacuugucggcgauacccccagaaagaaugacagcuccucuagcucccauugccuggauccgaacaaugaggaaggcgggcacggagugaaaggcugggccuucgacgaugggaacgacguuuggaugggacggacgaucagcgagaaacuccgcucuggcuacgagacauuuaaggugaucgaagggugguccaauccuaacagcaaacugcagauuaauagacaggucaucguggaucggggaaaccgcucuggcuauuccggcauuuucagcgucgaggggaaguccuguaucaauagaugcuuuuacguggaacugauucggggaagaaaagaggaaaccgagguucucuggaccucuaacagcaucguggucuucuguggcacauccgggaccuauggaacaggcucuuggcccgacggggcugauauuaaucugaugccuaucuga

SEQ ID NO: 203680 - RNA, 1410 nt, Artificial Sequence
  derived and/or modified sequence opt5 from neuraminidase__InfluenzaA__AEG65200
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagaggugcugcggacccaggaaucugagugugugugcaucaaugggacauguacggucguuaugaccgauggauccgcuagcggcaaggccgacacaaaaauucucuuuaucgaggaagggaagaucgugcacaccuccacacugucuggaagcgcgcaacacguggaggaaugcuccugcuauccucgcuaccccggcgucagaugugugugccgggauaacuggaaggggagcaaccgcccuauuguugacaucaauauuaaagacuacucuaucguguccagcuaugucuguucuggacuugugggcgauacccccagaaagaacgacagcuccucuagcucccauugccuggauccgaauaacgaggaaggcgggcacggaguuaaaggcugggccuucgacgaugggaaugacguguggaugggacggacgauuagcgagaagcuccgcucuggcuacgagacauuuaaagucaucgaagggugguccaacccuaauagcaagcugcagaccaacagacaggugaucgucgaucggggaaaucgcucuggcuauuccggcauuuucagcguggaggggaaauccuguaucaacagaugcuuuuacguugaacugauucggggaagaaaggaggaaaccgaggugcucuggacaucuaauagcaucgucguguucuguggcaccuccgggacauauggaacgggcucuuggcccgacggggcugauauuaaccugaugccuaucuga

SEQ ID NO: 203681 - RNA, 1410 nt, Artificial Sequence; identical to SEQ ID NO: 197736
  derived and/or modified sequence opt5 from neuraminidase__InfluenzaA__AEG65211

SEQ ID NO: 203682 - RNA, 1410 nt, Artificial Sequence; identical to SEQ ID NO: 197738
  derived and/or modified sequence opt5 from neuraminidase__InfluenzaA__AEG65222

SEQ ID NO: 203683 - RNA, 1410 nt, Artificial Sequence
  derived and/or modified sequence opt5 from neuraminidase__InfluenzaA__AEG65233
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucauugacaucaauauuaaggacuacucuaucguguccagcuauguuuguucuggacuugugggcgauacccccagaaagaacgacagcuccucuagcucccauugccuggauccgaauaacgaagagggcgggcacggagucaaaggcugggccuucgacgaugggaaugacguguggaugggacggacgaucagcgaaaaacuccgcucuggcuacgagacauuuaagguuauugaggggugguccaacccuaauagcaaacugcagaucaacagacaggugauugucgaucggggaaaucgcucuggcuauuccggcaucuucagcguggaagggaaguccuguauuaacagaugcuuuuacgucgagcugauccggggaagaaaggaagagaccgaagugcucuggaccucuaauagcauuguuguguucuguggcacauccgggaccuauggaacaggcucuuggcccgacggggcugauaucaaccugaugccuaucuga

SEQ ID NO: 203684 - RNA, 1410 nt, Artificial Sequence
  derived and/or modified sequence opt5 from neuraminidase__InfluenzaA__AEG65244
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggacccagcaggucugcauugccugguccucuagcuccugucacgacggaaaggccuggcugcaugugugcguuacaggcgaugacgagaacgcuaccgccagcuucaucuacaauggcagacuuguggauucuauugucuccuggagcaaaaagauccugcggacccaagaaucugagugugugugcauuaacgggacauguacgguggucaugaccgacggauccgcuagcggcaaagccgauacaaagauccucuuuaucgaggaagggaaaauuguucacaccuccacacugucuggaagcgcgcagcacguggaggaaugcuccugcuauccucgcuaccccggcgugagaugugucugccgggacaacuggaaggggagcaaucgcccuaucguggauauuaacaucaaggacuacucuauugccuccagcuauguuuguucuggacuugugggcgacacccccagaaagaaugauagcuccucuagcucccauugccuggacccgaacaaugaggaaggcgggcacggagucaaaggcugggcuuucgaugacgggaacgauguguggaugggacggacgaucagcgagaaacuccgcucuggcuacgagacauuuaagguuaucgaagggugguccaauccuaacagcaaacugcagauuaauagacaggugaucgucgaccggggaaaccgcucuggcuauuccggcauuuucagcguggaggggaaguccuguaucaauagaugcuuuuacgucgaacugauucggggaagaaaccaagagaccgaagugcucuggaccucuaauagcaucguuguguucuguggcacauccgggaccuauggaacaggcucuuggcccgauggggccgacauuaaccugaugccuaucuga

SEQ ID NO: 203685 - RNA, 1410 nt, Artificial Sequence; identical to SEQ ID NO: 197738
  derived and/or modified sequence opt5 from neuraminidase__InfluenzaA__AEG65255

SEQ ID NO: 203686 - RNA, 1410 nt, Artificial Sequence; identical to SEQ ID NO: 197615
  derived and/or modified sequence opt5 from neuraminidase__InfluenzaA__AEG65266

SEQ ID NO: 203687 - RNA, 1410 nt, Artificial Sequence; identical to SEQ ID NO: 197615
  derived and/or modified sequence opt5 from neuraminidase__InfluenzaA__AEG65277

SEQ ID NO: 203688 - RNA, 1410 nt, Artificial Sequence
  derived and/or modified sequence opt5 from neuraminidase__InfluenzaA__AEG65288
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaauaacucuuucagcuccucucacugucucgauccgaauaacgaagagggaggccaugggguuaaaggaugggccuuugacgauggcaaugacguguggauggggcgcaccauuagcgaaaagcugagauccggauaugagacguucaaagucaucgagggcuggagcaagccuaacucuaaacugcagaucaaucgccaggugauugucgaacggggcaacagauccggguacagcggaaucuuuucuguggagggcaaguccugcauuaaucgguguuucuauguugaacucaucagagggcgcaaggaggaaacagaggugugguggaccagcaacuccauugucguguuuugcggaaccucuggcacauacgggaccggcagcuggcccgauggagcugacaucaaucugaugccuauuuga

SEQ ID NO: 203689 - RNA, 1410 nt, Artificial Sequence; identical to SEQ ID NO: 197615
  derived and/or modified sequence opt5 from neuraminidase__InfluenzaA__AEG65299

SEQ ID NO: 203690 - RNA, 1410 nt, Artificial Sequence; identical to SEQ ID NO: 197738
  derived and/or modified sequence opt5 from neuraminidase__InfluenzaA__AEG65310

SEQ ID NO: 203691 - RNA, 1410 nt, Artificial Sequence; identical to SEQ ID NO: 197738
  derived and/or modified sequence opt5 from neuraminidase__InfluenzaA__AEG65321

SEQ ID NO: 203692 - RNA, 1410 nt, Artificial Sequence; identical to SEQ ID NO: 197738
  derived and/or modified sequence opt5 from neuraminidase__InfluenzaA__AEG65332

SEQ ID NO: 203693 - RNA, 1410 nt, Artificial Sequence; identical to SEQ ID NO: 197738
  derived and/or modified sequence opt5 from neuraminidase__InfluenzaA__AEG65354

SEQ ID NO: 203694 - RNA, 1410 nt, Artificial Sequence; identical to SEQ ID NO: 197738
  derived and/or modified sequence opt5 from neuraminidase__InfluenzaA__AEG65365

SEQ ID NO: 203695 - RNA, 1410 nt, Artificial Sequence
  derived and/or modified sequence opt5 from neuraminidase__InfluenzaA__AEG65376
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggacccagcaggucugcauugccugguccucuagcuccugucacgacggaaaggccuggcugcaugugugcguuacaggcgaugacgagaacgcuaccgccagcuucaucuacaauggcagacuuguggauucuauugucuccuggagcaaaaagauccugcggacccaagaaucugagugugugugcauuaacgggacauguacgguggucaugaccgacggauccgcuagcggcaaagccgauacaaagauccucuuuaucgaggaagggaaaauuguucacaccuccacacugucuggaagcgcgcagcacguggaggaaugcuccugcuauccucgcuaccccggcgugagaugugucugccgggacaacuggaaggggagcaaucgcccuaucguggauauuaacaucaaggacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaaacuccgcucuggcuacgagacauuuaaggugaucgaagggugguccaauccuaacagcaaacugcagauuaauagacaggucaucguggaccggggaaaccgcucuggcuauuccggcauuuucagcgucgaggggaaguccuguaucaauagaugcuuuuacguggaacugauucggggaagaaaccaagagaccgaaguucucuggaccucuaauagcaucguggucuucuguggcacauccgggaccuauggaacaggcucuuggcccgauggggcugacauuaaccugaugccuaucuga

SEQ ID NO: 203696 - RNA, 1410 nt, Artificial Sequence; identical to SEQ ID NO: 197615
  derived and/or modified sequence opt5 from neuraminidase__InfluenzaA__AEG65387

SEQ ID NO: 203697 - RNA, 1410 nt, Artificial Sequence; identical to SEQ ID NO: 197615
  derived and/or modified sequence opt5 from neuraminidase__InfluenzaA__AEG65398

SEQ ID NO: 203698 - RNA, 1410 nt, Artificial Sequence; identical to SEQ ID NO: 197615
  derived and/or modified sequence opt5 from neuraminidase__InfluenzaA__AEG65409

SEQ ID NO: 203699 - RNA, 1410 nt, Artificial Sequence; identical to SEQ ID NO: 197615
  derived and/or modified sequence opt5 from neuraminidase__InfluenzaA__AEG65420

SEQ ID NO: 203700 - RNA, 1410 nt, Artificial Sequence; identical to SEQ ID NO: 197615
  derived and/or modified sequence opt5 from neuraminidase__InfluenzaA__AEG65431

SEQ ID NO: 203701 - RNA, 1410 nt, Artificial Sequence; identical to SEQ ID NO: 197736
  derived and/or modified sequence opt5 from neuraminidase__InfluenzaA__AEG65442

SEQ ID NO: 203702 - RNA, 1410 nt, Artificial Sequence; identical to SEQ ID NO: 197738
  derived and/or modified sequence opt5 from neuraminidase__InfluenzaA__AEG65453

SEQ ID NO: 203703 - RNA, 1410 nt, Artificial Sequence; identical to SEQ ID NO: 197738
  derived and/or modified sequence opt5 from neuraminidase__InfluenzaA__AEG65464

SEQ ID NO: 203704 - RNA, 1410 nt, Artificial Sequence; identical to SEQ ID NO: 197738
  derived and/or modified sequence opt5 from neuraminidase__InfluenzaA__AEG65475

SEQ ID NO: 203705 - RNA, 1410 nt, Artificial Sequence
  derived and/or modified sequence opt5 from neuraminidase__InfluenzaA__AEG65486
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugagcaucggaauugguccaagccccagugugacauuaccggguucgccccuuuuucuaaagauaacagcauccgccuguccgcgggaggcgacaucugggugacaagagagcccuacgucucuugcgauccugacaaguguuaucaauucgcucuugggcagggaaccacacugaauaacgugcacagcaaugauaccguucaugaccggacgccguaccgcacacuccugaugaacgaacugggcgugcccuuucaccucgggaccaagcaggucugcauugccugguccucuagcuccugucaugauggaaaagccuggcugcacgugugcguuacaggcgacgauaagaaugcuaccgccagcuucaucuauaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacauguggaagagugcuccugcuacccucgcuaucccggcgugagaugugucugccgggauaacuggaaagggagcaaccgcccuaucguggacauuaauaucaaggacuacucuauuguuuccagcuacguguguucuggacuugucggcgauacccccagaaagaacgacagcuccucuagcucccacugccuggauccgaauaacgaagagggcgggcauggagugaaaggcugggccuucgacgaugggaaugacguuuggaugggacggacgaucagcgaaaaacuccgcucuggcuaugagacauuuaaggugaucgaggggugguccaacccuaauagcaaacugcagauuaacagacaggucaucguggaucggggaaaucgcucuggcuacuccggcauuuucagcgucgaagggaaguccuguaucaacagaugcuuuuauguggagcugauucggggaagaaaggaagagaccgaaguucucuggaccucuaauagcaucguggucuucuguggcacauccgggaccuacggaacaggcucuuggcccgacggggcugauauuaaccugaugccuaucuga

SEQ ID NO: 203706 - RNA, 1410 nt, Artificial Sequence; identical to SEQ ID NO: 197738
  derived and/or modified sequence opt5 from neuraminidase__InfluenzaA__AEG65497

SEQ ID NO: 203707 - RNA, 1410 nt, Artificial Sequence; identical to SEQ ID NO: 197738
  derived and/or modified sequence opt5 from neuraminidase__InfluenzaA__AEG65508

SEQ ID NO: 203708 - RNA, 1410 nt, Artificial Sequence; identical to SEQ ID NO: 197738
  derived and/or modified sequence opt5 from neuraminidase__InfluenzaA__AEG65519

SEQ ID NO: 203709 - RNA, 1410 nt, Artificial Sequence; identical to SEQ ID NO: 197738
  derived and/or modified sequence opt5 from neuraminidase__InfluenzaA__AEG65530

SEQ ID NO: 203710 - RNA, 1410 nt, Artificial Sequence; identical to SEQ ID NO: 197738
  derived and/or modified sequence opt5 from neuraminidase__InfluenzaA__AEG65541

SEQ ID NO: 203711 - RNA, 1410 nt, Artificial Sequence
  derived and/or modified sequence opt5 from neuraminidase__InfluenzaA__AEG65563
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugaccgguguuaccaauucgcucuugggcagggaaccacacugaauaacgugcauagcaaugauaccguucacgaccgcacgccguauagaacacuccugaugaacgaacugggcgugcccuuucaucucgggaccaagcaggucugcauugccugguccucuagcuccugucacgauggaaaggccuggcugcaugugugcguuacaggcgacgauaaaaaugcuaccgccagcuucaucuacaacggccggcuuguggacucuauugucuccuggagcaagaaaauccugcgcacccaggagucugaaugugugugcauuaaugggacauguacgguggucaugaccgauggauccgcuagcggcaaggccgacacaaaaauccucuuuaucgaggaggggaagauuguucacaccuccacacugucuggaagcgcgcaacacguggaagagugcuccugcuauccuagauaccccggcgugcggugugucugccgcgauaacuggaaggggagcaacagaccuaucguggacauuaauaucaaagacuacucuauuguuuccagcuauguguguucuggacuugucggcgauacgccccggaagaacgacagcuccucuagcucccauugccuggauccgaauaacgaagagggcgggcacggagugaaaggcugggccuucgacgaugggaaugacguuuggaugggacgcaccaucagcgaaaagcucagaucuggcuacgagacauuuaaagugaucgaggggugguccaacccuaauagcaagcugcagauuaaccggcaggucaucguggaucgcggaaauagaucuggcuauuccggcauuuucagcgucgaagggaaauccuguaucaaccggugcuuuuacguggagcugauuagaggacgcaaggaagagaccgaaguucucuggaccucuaauagcaucguggucuucuguggcacauccgggaccuauggaacaggcucuuggcccgacggggcugauauuaaccugaugccuaucuga

SEQ ID NO: 203712 - RNA, 1410 nt, Artificial Sequence
  derived and/or modified sequence opt5 from neuraminidase__InfluenzaA__AEG65574
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccgguccuggucuaagccccagugugacauuaccggguucgccccuuuuagcaaagauaauuccauccgccugucugcgggaggcgacaucugggugacaagagagcccuaugucagcugcgauccugaccgguguuaccaauucgcucuugggcagggaaccacacugaacaaugugcauuccaacgauaccguucacgaccgcacgccguauagaacacuccugaugaaugaacugggcgugcccuuucaucucgggaccaagcaggucugcauugccuggucuagcuccagcugucacgauggaaaggccuggcugcaugugugcguuacaggcgacgauaaaaacgcuaccgccucuuucaucuacaauggccggcuuguggacuccauugucagcuggucuaagaaaauccugcgcacccaggaguccgaaugugugugcauuaacgggacauguacgguggucaugaccgauggaagcgcuuccggcaaggccgacacaaaaauccucuuuaucgaggaggggaagauuguucacaccucuacacugagcggauccgcgcaacacguggaagagugcagcugcuauccuagauaccccggcgugcggugugucugccgcgauaauuggaaggggucuaacagaccuaucguggacauuaacaucaaagacuacuccauuguuagcucuuauguguguagcggacuugucggcgauacgccccggaagaaugacuccucuagcuccagccauugccuggauccgaacaaugaagagggcgggcacggagugaaaggcugggccuucgacgaugggaacgacguuuggaugggacgcaccaucucugaaaagcucagauccggcuacgagacauuuaaagugaucgagggguggagcaauccuaacucuaagcugcagauuaaucggcaggucaucguggaucgcggaaacagauccggcuauagcggcauuuucuccgucgaagggaaaucuuguaucaaucggugcuuuuacguggagcugauuagaggacgcaaggaagagaccgaaguucucuggaccagcaacuccaucguggucuucuguggcacaucugggaccuauggaacaggcagcuggcccgacggggcugauauuaaucugaugccuaucuga

SEQ ID NO: 203713 - RNA, 1410 nt, Artificial Sequence; identical to SEQ ID NO: 203711
  derived and/or modified sequence opt5 from neuraminidase__InfluenzaA__AEG65585

SEQ ID NO: 203714 - RNA, 1410 nt, Artificial Sequence; identical to SEQ ID NO: 203711
  derived and/or modified sequence opt5 from neuraminidase__InfluenzaA__AEG65596

SEQ ID NO: 203715 - RNA, 1410 nt, Artificial Sequence
  derived and/or modified sequence opt5 from neuraminidase__InfluenzaA__AEG65607
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauugccuccagcuauguuuguucuggacuugugggcgauacccccagaaagaacgacagcuccucuagcucccauugccuggauccgaauaacgaagagggcgggcacggagucaaaggcugggcuuucgacgaugggaaugacguguggaugggacggacgaucagcgaaaaacuccgcucuggcuacgagacauuuaagguuaucgaggggugguccaacccuaauagcaaacugcagauuaacagacaggugaucgucgaucggggaaaucgcucuggcuauuccggcauuuucagcguggaagggaaguccuguaucaacagaugcuuuuacgucgagcugauucggggaagaaaggaagagaccgaagugcucuggaccucuaauagcaucguuguguucuguggcacauccgggaccuauggaacaggcucuuggcccgacggggccgauauuaaccugaugccuaucuga

SEQ ID NO: 203716 - RNA, 1410 nt, Artificial Sequence
  derived and/or modified sequence opt5 from neuraminidase__InfluenzaA__AEG65629
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaaugacgaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaucgagguucucuggaccucuaacagcauuguggucuucuguggcaccuccgggacauauggaaccggcucuuggcccgauggggcugacaucaaucugaugccuaucuga

SEQ ID NO: 203717 - RNA, 1410 nt, Artificial Sequence; identical to SEQ ID NO: 203716
  derived and/or modified sequence opt5 from neuraminidase__InfluenzaA__AEG65640

SEQ ID NO: 203718 - RNA, 1410 nt, Artificial Sequence; identical to SEQ ID NO: 197159
  derived and/or modified sequence opt5 from neuraminidase__InfluenzaA__AEG65651

SEQ ID NO: 203719 - RNA, 1410 nt, Artificial Sequence; identical to SEQ ID NO: 197738
  derived and/or modified sequence opt5 from neuraminidase__InfluenzaA__AEG65662

SEQ ID NO: 203720 - RNA, 1410 nt, Artificial Sequence; identical to SEQ ID NO: 197738
  derived and/or modified sequence opt5 from neuraminidase__InfluenzaA__AEG65673

SEQ ID NO: 203721 - RNA, 1410 nt, Artificial Sequence; identical to SEQ ID NO: 197738
  derived and/or modified sequence opt5 from neuraminidase__InfluenzaA__AEG65684

SEQ ID NO: 203722 - RNA, 1410 nt, Artificial Sequence; identical to SEQ ID NO: 203695
  derived and/or modified sequence opt5 from neuraminidase__InfluenzaA__AEG65695

SEQ ID NO: 203723 - RNA, 1410 nt, Artificial Sequence
  derived and/or modified sequence opt5 from neuraminidase__InfluenzaA__AEG65706
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaacgagguucucuggaccucuaauagcaucguggucuucuguggcaccuccgggacauauggaaccggcucuuggcccgauggggcugacauuaaccugaugccuaucuga

SEQ ID NO: 203724 - RNA, 1410 nt, Artificial Sequence
  derived and/or modified sequence opt5 from neuraminidase__InfluenzaA__AEG65728
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucucuggaccucuaacagcaucguggucuucuguggcacauccgggaccuauggaacaggcucuuggcccgauggggcugagauuaaucugaugccuaucuga

SEQ ID NO: 203725 - RNA, 1410 nt, Artificial Sequence
  derived and/or modified sequence opt5 from neuraminidase__InfluenzaA__AEG65739
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcccugugaaccuacaauuaucgagagaaacauuaccgaaaucguguaucuuacaaauaccacgauugagaaggaaaucugccccaaacuggcugaguaccggaacuggucuaagccucagugugacauuaccggguucgcccccuuuagcaaagauaauuccauccgccucucugcgggaggcgacaucugggugacaagagagccuuaugucagcugcgauccggacaaguguuaccaauucgcucuggggcagggaaccacacuuaacaaugugcauuccaacgauaccguucacgaccggacgcccuaucgcacacugcucaugaaugaacugggcgugccuuuucaucuggggaccaagcaggucugcauugccuggucuagcuccagcugucacgauggaaaagccuggcuccaugugugcguuacaggcgacgauaagaacgcuaccgccucuuucaucuacaauggcagacugguggacuccauugucagcuggucuaaagagauccuucggacccaggaauccgagugugugugcauuaacgggacauguacgguggucaugaccgauggaagcgcuuccggcaaggccgacacaaaaauccuguuuaucgaggaagggaagauuguucacaccucuacacucagcggauccgcgcaacacguggaggaaugcagcugcuauccccgcuacccuggcgugagaugugucugccgggauaauuggaaggggucuaaccgccccaucguggacauuaacaugaaagacuacuccaucguuagcucuuauguguguagcggacuggucggcgauaccccgagaaagaaugacuccucuagcuccagccauugccuugauccuaacaaugaggaaggcgggcacggagugaaaggcugggccuucgacgaugggaacgacguuuggaugggacggacgauuucugagaagcugcgcuccggcuacgagacauuuaaagugaucgaaggguggagcaaucccaacucuaagcuccagaucaauagacaggucauuguggaucggggaaaccgcuccggcuauagcggcaucuucuccgucgaggggaaaucuuguauuaauagaugcuuuuacguggaacugauccggggaagaaaggaggaaaccgagguucuguggaccagcaacuccauuguggucuucuguggcacaucugggaccuauggaacaggcagcuggccugacggggcugauaucaaucucaugcccauuuga

SEQ ID NO: 203726 - RNA, 1410 nt, Artificial Sequence; identical to SEQ ID NO: 199588
  derived and/or modified sequence opt5 from neuraminidase__InfluenzaA__AEG65750

SEQ ID NO: 203727 - RNA, 1410 nt, Artificial Sequence; identical to SEQ ID NO: 203724
  derived and/or modified sequence opt5 from neuraminidase__InfluenzaA__AEG65761

SEQ ID NO: 203728 - RNA, 1410 nt, Artificial Sequence
  derived and/or modified sequence opt5 from neuraminidase__InfluenzaA__AEG65772
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaaugugcccuaaacucgcugaguaccggaauugguccaagccccagugugacauuacaggguucgccccuuuuucuaaagauaacagcauccgccuguccgcgggaggcgacauuugggugaccagagagcccuaugucucuugcgauccugacaaguguuaccaauucgcucuugggcagggaacaacccugaauaacgugcauagcaaugauacgguucacgaccggacaccguaucgcacccuccugaugaacgaacugggcgugcccuuucaucucgggacaaagcaggucugcaucgccugguccucuagcuccugucacgauggaaaagccuggcugcaugugugcguuaccggcgacgauaagaaugcuaccgccagcuucaucuacaacggcagacuuguggacucuauugucuccuggagcaaaaagauccugcggacacaggagucugaaugugugugcauuaaugggacguguaccguggucaugacagauggauccgcuagcggcaaagccgacaccaagauccucuuuauugaggaggggaagaucauccacacauccacccugucuggaagcgcgcaacacguugaagagugcuccugcuauccucgcuaccccggcgugagaugugugugccgggauaacuggaaagggagcaaccgcccuauugucgacaucaauauuaaggacuacucuaucguguccagcuauguuuguucuggacuugugggcgauacgccccggaaaaacgacagcuccucuagcucccauugccuggauccgaauaacgaagagggcgggcacggagucaagggcugggccuucgacgaugggaaugacguguggaugggaagaacaauuagcgaaaaacuccgcucuggcuacgagaccuuuaagguuaucgaggggugguccaaaccuaacagcaagcugcagaucaauagacaggugauugucgaucggggaaaccgcucuggcuauuccggcaucuucagcguggaagggaaguccuguauuaauagaugcuuuuacgucgagcugauccggggaagaaaagaagagaccgaagugcucuggacaucuaacagcauuguuguguucuguggcaccuccgggacauauggaacgggcucuuggcccgacggggcugauaucaaucugaugccuauuuga

SEQ ID NO: 203729 - RNA, 1410 nt, Artificial Sequence; identical to SEQ ID NO: 202542
  derived and/or modified sequence opt5 from neuraminidase__InfluenzaA__AEG65783

SEQ ID NO: 203730 - RNA, 1410 nt, Artificial Sequence
  derived and/or modified sequence opt5 from neuraminidase__InfluenzaA__AEG65794
augaaccccaaucagaagaucauuaccaucggcagcgugucccugacaauuucuacgaucugcuucuuuaugcaaauugccauccucaucaccacaauuacccugcacuucaaacaguacgaguuuaacagcccuccgaauaaccaggucaugcuuugugaacccacaaucauugagagaaauaucaccgaaauuguuuaucugacaaacaccacgaucgagaaggaaauuugcccuaaacucgcugaguaccggaauugguccaagccccagugugacaucaccggguucgccccuuuuucuaaagauaacagcauccgccuguccgcgggaggcgacauuugggugacaagagagcccuaugugucuugcgauccugacaaguguuaccaauucgcucuugggcagggaaccacacugaauaacguccauagcaauaacaccgugcgggaucgcacgccguauagaacacuccugaugaaugaacugggcguucccuuucaccucgggaccaaacaggugugcaucgccugguccagcagcuccugucaugacggaaaggccuggcugcacgucugcauuacaggcgaugacaagaacgcuaccgccagcuucaucuacaauggccggcuuguggauucuguuguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucaaugagacaagcagacucggcuaugagaccuuuaagguuauugaaggguggucuaacccuaaauccaagcugcagaucaaucgccaggugauugucgacaaaggaaaccggagcggcuacucuggcaucuucuccguggaggggaagucuuguauuaauagaugcuuuuaugucgaacugauccggggaagaaaggaggaaaccgaggugcucuggacauccaacucuauuguuguguucuguggcaccagcgggacauacggaacgggcuccuggcccgauggggcugaccugaaucuuaugccuaucuga

SEQ ID NO: 203731 - RNA, 1410 nt, Artificial Sequence; identical to SEQ ID NO: 202542
  derived and/or modified sequence opt5 from neuraminidase__InfluenzaA__AEG65805

SEQ ID NO: 203732 - RNA, 1410 nt, Artificial Sequence
  derived and/or modified sequence opt5 from neuraminidase__InfluenzaA__AEG65816
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcgaggccgauacaaagauccucuuuaucgaagaggggaaaauuguucauaccuccacacugucuggaagcgcgcaacacguggaagagugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucaaugagacaagcagacucggcuaugaaaccuuuaaagugaucgagggguggucuaacccuaaguccaaacugcagauuaaucggcaggucaucguggaccgcggaaacagaagcggcuacucuggcauuuucuccgucgaagggaagucuuguaucaaucggugcuuuuauguggagcugauuagaggacgcaaagaagagaccgagguucucuggacauccaacucuaucguggucuucuguggcaccagcgggacauacggaacgggcuccuggcccgauggggcugaccugaaucuuaugccuauuuga

SEQ ID NO: 203733 - RNA, 1410 nt, Artificial Sequence
  derived and/or modified sequence opt5 from neuraminidase__InfluenzaA__AEG79808
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaccggaaccgacaacaauuuuagcaucaaacaagacauuguuggcaucaacgaaugguccggguacucuggcagcuucgugcagcaucccgagcuuacaggacuggauuguauucgcccuugcuucugggucgaacucaucagaggccggcccaaggagaauacgauuuggaccuccgggagcucuaucuccuuuuguggagugaacagcgacacaguuggcuggucuuggcccgauggggcugagcugccuuucaccaucgacaaauga

SEQ ID NO: 203734 - RNA, 1410 nt, Artificial Sequence; identical to SEQ ID NO: 203733
  derived and/or modified sequence opt5 from neuraminidase__InfluenzaA__AEG79814

SEQ ID NO: 203735 - RNA, 1410 nt, Artificial Sequence
  derived and/or modified sequence opt5 from neuraminidase__InfluenzaA__AEG79826
augaaccccaaucagaagaucauuaccaucagcuccgugugcaugacaauuggcauggccaaccugauccuccaaauugggaauaucaucucuauuuggaucagccacuccauucagcugggaaaccagaaucagaucgagacguguaaccaaucugucauuaccuacgaaaauaacacauggguuaaucagaccuaugugaacaucagcaauacaaacuucgcugccggccaguccguggucucugugaaacuugcggggaauagcucccugugcccuguuagcggaugggcuauuuacucuaaggacaacuccaucagaaucggcagcaaaggggauguguuugucauucgggagccguucaucucuuguucuccccucgaaugccgcaccuuuuuccugacacagggagcccuucugaaugacaagcauagcaacggcaccauuaaagauagaucuccuuaucggacgcucauguccugucccaucggcgaggugccuagccccuacaacucccgcuuugaaucuguugccuggagcgcuuccgccugccacgacgggauuaauuggcugaccaucggaaucagcggcccugauaacggggcuguggccguccugaaguauaauggaauuaucacagacaccauuaagucuuggagaaacaauauccuccggacacaagaguccgagugugcgugcgugaacggcagcuguuucaccauuaugacggaugggccgucugacggacaggccagcuacaaaaucuuucgcaucgaaaagggcaaaauugugaaguccgucgagaugaaugcucccaacuaucauuacgaagagugcucuuguuacccugauagcuccgagaucacaugcguuugcagagacaauuggcacggcagcaaccggcccugggugucuuucaaucagaaccuggaauaucagauuggguacaucuguuccggaauuuuuggcgauaauccucgccccaacgacaaaaccgggagcugcggaccggugucuuccaauggcgccaacggggucaagggauucagcuuuaaguauggcaacggcguguggaucgggagaacaaaauccauuucuagccggaagggauucgagaugaucugggauccuaauggcuggaccgggaccgacaacaauuuuuccaucaaacaagacauuguuggaaucaacgaauggucuggcuacagcggguccuucgugcagcaucccgagcuuacaggccuggauuguauucgcccuugcuucugggucgaacucaucagaggacggcccaaggagaauacgauuuggaccagcggcuccuccaucagcuuuuguggggugaacucugacacaaugggaugguccuggcccgauggcgcugagcugccuuucaccaucgacaaauga

SEQ ID NO: 203736 - RNA, 1410 nt, Artificial Sequence
  derived and/or modified sequence opt5 from neuraminidase__InfluenzaA__AEG79830
augaaccccaaucagaagaucauuaccaucagcuccgugugcaugacaauuggcauggccaaccugauccuccaaauugggaauaucaucucuauuuggaucagccacuccauucagcugggaaaccagaaucagaucgagacguguaaccaaucugucauuaccuacgaaaauaacacauggguuaaucagaccuaugugaacaucagcaauacaaacuucgcugccggccaguccguggucucugugaaacuugcggggaauagcucccugugcccuguuagcggaugggcuauuuacucuaaggacaacuccaucagaaucggcagcaaaggggauguguuugucauucgggagccguucaucucuuguucuccccucgaaugccgcaccuuuuuccugacacagggagcccuucugaaugacaagcauagcaacggcaccauuaaagauagaucuccuuaucggacgcucauguccugucccaucggcgaggugccuagccccuacaacucccgcuuugaaucuguugccuggagcgcuuccgccugccacgacgggauuaauuggcugaccaucggaaucagcggcccugauaacggggcuguggccguccugaaguauaauggaauuaucacagacaccauuaagucuuggagaaacaauauccuccggacacaagaguccgagugugcgugcgugaacggcagcuguuucaccgugaugacggaugggccgucugacggacaggccagcuacaaaauuuuucgcaucgaaaagggcaaaaucgucaaguccguugagaugaaugcucccaacuaucauuacgaagagugcucuuguuacccugauagcuccgagauuacaugcgugugcagagacaauuggcacggcagcaaccggcccugggugucuuucaaucagaaccuggaauaucagaucggguacauuuguuccggaaucuuuggcgauaauccucgccccaacgacaaaaccgggagcugcggaccggucucuuccaauggcgccaacggggugaagggauucagcuuuaaguauggcaacggcguuuggauugggagaacaaaauccaucucuagccggaagggauucgagaugauuugggauccuaauggcuggaccgggaccgacaacaauuuuuccaucaaacaagacaucgugggaauuaacgaauggucuggcuacagcggguccuucguccagcaucccgagcuuacaggccuggauuguauccgcccuugcuucuggguggaacucauuagaggacggcccaaggagaauacgaucuggaccagcggcuccuccauuagcuuuugugggguuaacucugacacagugggaugguccuggcccgauggcgcugagcugccuuucaccaucgacaaauga

SEQ ID NO: 203737 - RNA, 1410 nt, Artificial Sequence; identical to SEQ ID NO: 203281
  derived and/or modified sequence opt5 from neuraminidase__InfluenzaA__AEG79836

SEQ ID NO: 203738 - RNA, 1410 nt, Artificial Sequence
  derived and/or modified sequence opt5 from neuraminidase__InfluenzaA__AEH59356
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcacccuucugaaugacaagcauuccaacggcacgauuaaagauagaagcccuuaucggacccucaugucuugucccaucggggaggugccuucccccuacaacagccgcuuugaauccguugccuggucugccagcgcuugccacgacggaauuaauuggcugacaaucggcaucuccgggccugauaacggagccguggcuguccugaaguauaauggcauuaucaccgacacaauuaagagcuggagaaacaauauccuccggacccaagagucugagugugccugcgugaacggguccuguuucacgauuaugacagauggaccgagcgacggccaggcgucuuacaaaaucuuucgcaucgaaaagggcaaaauugucaagagcguggagaugaaugcccccaacuauuacuacgaagagugcuccuguuauccugauucuagcgagauuaccugcguuugcagagacaauuggcauggguccaaccggcccugggugagcuucaaucagaaccuggaauaccagaucggauauaucuguucuggcauuuuuggggauaauccucgccccaacgacaaaacaggauccugcggcccggugagcucuaauggggcuaacggagucaagggcuucuccuuuaaguacggcaacgggguguggaucggaagaaccaaaagcauuuccucucggaagggcuucgagaugaucugggauccuaauggguggaccggaacagacaacaauuuuagcaucaaacaagacauuguuggcaucaacgaaugguccggguauucuggcagcuucgugcagcaccccgagcuuacgggacuggauuguauucgcccuugcuucugggucgaacucaucagaggccggcccaaggagaauaccguguggacauccgggagcucuauuuccuuuuguggaguuaacagcgacaccgugggcuggucuuggcccgauggggccgagcugccuuucacaaucgacaaauga

SEQ ID NO: 203739 - RNA, 1410 nt, Artificial Sequence; identical to SEQ ID NO: 203733
  derived and/or modified sequence opt5 from neuraminidase__InfluenzaA__AEH59360

SEQ ID NO: 203740 - RNA, 1410 nt, Artificial Sequence
  derived and/or modified sequence opt5 from neuraminidase__InfluenzaA__AEH59364
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgaaugacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacggggccaaucggcccugggugagcuucaaccagaaucuggaauaucagaucggauacauuuguuccggcaucuuuggggauaacccucgccccaaugacaaaaccggaagcugcggcccggucucuuccaacggggcuaacggagugaagggcuucagcuuuaaguauggcaaugggguuuggauuggaagaacaaaaucuaucuccagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccucugggagcuccauuagcuuuuguggaguuaacucugacacagugggcugguccuggcccgauggggccgagcugccuuucaccaucgacaaguga

SEQ ID NO: 203741 - RNA, 1410 nt, Artificial Sequence
  derived and/or modified sequence opt5 from neuraminidase__InfluenzaA__AEH59366
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucgggggagugccuucccccuacaacagccgcuuugaguccguugccuggucugcuagcgccugccacgacggcauuaauuggcugaccaucgggaucuccggaccugauaacggcgcuguggccguccugaaguauaaugggauuaucacagacaccauuaagagcuggagaaacaauauccuccggacacaagaaucugagugugcgugcgugaacggauccuguuucaccauuaugacggauggcccgagcgacggccaggccucuuacaaaaucuuucgcaucgagaaggggaaaauugucaagagcguggaaaugaaugcucccaacuaucauuacgaggaaugcuccuguuacccugauucuagcgagaucacaugcguuugcagagacaauuggcacggauccaaccggcccugggugagcuucaaucagaaccuggaguaucagauuggcuacaucuguucugggauuuuuggagauaauccucgccccaacgacaaaaccggcuccugcgggccggugagcucuaauggagccaacggcgucaagggcuucuccuuuaaguaugggaacggaguguggaucggcagaacaaaaagcauuuccucucggaagggguucgaaaugaucugggauccuaauggauggaccggcaccgacaacaauuuuagcaucaaacaagacauuguugggaucaacgagugguccggcuacucuggcagcuucgugcagcaucccgaacuuacaggacuggauuguauucgcccuugcuucugggucgagcucaucagagggcggcccaaggaaaauacgauuuggaccuccggaagcucuaucuccuuuuguggcgugaacagcgacacaguuggguggucuuggcccgauggagcugagcugccuuucaccaucgacaaauga

SEQ ID NO: 203742 - RNA, 1410 nt, Artificial Sequence; identical to SEQ ID NO: 203733
  derived and/or modified sequence opt5 from neuraminidase__InfluenzaA__AEH59368

SEQ ID NO: 203743 - RNA, 1410 nt, Artificial Sequence; identical to SEQ ID NO: 203281
  derived and/or modified sequence opt5 from neuraminidase__InfluenzaA__AEH59370

SEQ ID NO: 203744 - RNA, 1410 nt, Artificial Sequence; identical to SEQ ID NO: 203740
  derived and/or modified sequence opt5 from neuraminidase__InfluenzaA__AEH59372

SEQ ID NO: 203745 - RNA, 1410 nt, Artificial Sequence; identical to SEQ ID NO: 203740
  derived and/or modified sequence opt5 from neuraminidase__InfluenzaA__AEH59376

SEQ ID NO: 203746 - RNA, 1410 nt, Artificial Sequence; identical to SEQ ID NO: 203281
  derived and/or modified sequence opt5 from neuraminidase__InfluenzaA__AEH59378

SEQ ID NO: 203747 - RNA, 1410 nt, Artificial Sequence; identical to SEQ ID NO: 203740
  derived and/or modified sequence opt5 from neuraminidase__InfluenzaA__AEH59382

SEQ ID NO: 203748 - RNA, 1410 nt, Artificial Sequence
  derived and/or modified sequence opt5 from neuraminidase__InfluenzaA__AEH59384
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcagaauugugaaauccgucgagaugaacgcucccaauuaucauuacgaagagugcucuuguuacccugauagcuccgagaucacaugcguuugccgggacaacuggcacgggagcaaucgccccugggugucuuucaaccagaaucuggaauaucagauuggauacaucuguuccggcauuuuuggggauaacccuagacccaaugacaagaccggaagcugcggcccggugucuuccaacggggccaauggagucaaaggcuucagcuuuaaguauggcaacgggguguggaucggacggacaaaguccauuucuagccgcaaaggcuucgagaugaucugggauccuaacggguggaccggaaccgacaauaacuuuuccaucaagcaagacauuguuggcaucaaugaauggucuggguacagcggcuccuucgugcagcaucccgagcuuacaggacuggauuguauuagaccuugcuucugggucgaacucauccggggccgccccaaagagaacacgauuuggaccagcgggucuuccaucagcuuuuguggaguuaauucugacacagugggcugguccuggcccgauggggcugagcugccuuucaccaucgacaaguga

SEQ ID NO: 203749 - RNA, 1410 nt, Artificial Sequence
  derived and/or modified sequence opt5 from neuraminidase__InfluenzaA__AEH59386
augaaccccaaucagaagaucauuaccaucggcagcgugugcaugacaauugggauggccaaccugauccuccaaauuggaaauaucaucuccauuuggaucucucacagcauucagaucggcaaccagaaucagauugagacguguaaccaauccgucaucaccuacgaaaauaacacauggguuaaucagaccuaugugaacauuucuaauacaaacuucgcugccgggcagagcguggucuccgugaaacuggcgggaaauucuagccuuugcccuguuuccggcugggcuaucuacagcaaggacaacucuaucagaauuggguccaaaggagauguguuugucauccgggagccguucauuagcuguucuccccuggaaugccgcaccuuuuuccucacacagggcgcccugcuuaaugacaagcauuccaacggcaccaucaaagauagaagcccuuaucggacgcugaugucuugucccauuggggaggugccuucccccuacaacagccgcuuugaauccguugccuggucugcuagcgccugccacgacggaaucaauuggcucaccaucggcauuuccgggccugauaacggagcuguggccguccugaaguauaauggcaucauuacagacaccaucaagagcuggagaaacaauauucugcggacacaagagucugagugugcgugcgugaacggguccuguuucaccaucaugacggauggaccgagcgacggccaggccucuuacaaaaucuuucgcauugaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccucgaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaagggcuucgagaugaucugggauccuaauggguggaccggaaccgacaacaauuuuagcauuaaacaagacaucguuggcauuaacgaaugguccggguacucuggcagcuucgugcagcaucccgagcugacaggacuugauuguauccgcccuugcuucugggucgaacugauuagaggccggcccaaggagaauacgaucuggaccuccgggagcucuaucuccuuuuguggagugaacagcgacacaguuggcuggucuuggcccgauggggcugagcucccuuucaccauugacaaauga

SEQ ID NO: 203750 - RNA, 1410 nt, Artificial Sequence; identical to SEQ ID NO: 203740
  derived and/or modified sequence opt5 from neuraminidase__InfluenzaA__AEH59388

SEQ ID NO: 203751 - RNA, 1410 nt, Artificial Sequence
  derived and/or modified sequence opt5 from neuraminidase__InfluenzaA__AEH59390
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggccuuaaugaauggucuggguacagcggcuccuucgugcagcaucccgagcugacaggacucgauuguauccgcccuugcuucugggucgaacugauuagaggccuucccaaggagaacacgaucuggaccagcgggucuuccauuagcuuuuguggaguuaauucugacacagugggcugguccuggcccgauggggcugagcugccuuucaccaucgacaaauga

SEQ ID NO: 203752 - RNA, 1410 nt, Artificial Sequence; identical to SEQ ID NO: 203740
  derived and/or modified sequence opt5 from neuraminidase__InfluenzaA__AEH59392

SEQ ID NO: 203753 - RNA, 1410 nt, Artificial Sequence; identical to SEQ ID NO: 203740
  derived and/or modified sequence opt5 from neuraminidase__InfluenzaA__AEH59396

SEQ ID NO: 203754 - RNA, 1410 nt, Artificial Sequence
  derived and/or modified sequence opt5 from neuraminidase__InfluenzaA__AEH59398
augaaccccaaucagaagaucauuaccaucggcagcgugugcaugacaauuggggucgccaaccugauccuccaaauuggaaauaucaucuccauuuggaucucucacagcauucagcugggcaaccagaaucagaucgagacguguaaccaauccguuauuaccuacgaaaauaacacaugggugaaucagaccuaugugaacaucucuaauacaaacuucgcugccgggcagagcgucguguccguuaaacuugcgggaaauucuagccugugcccuguguccggcugggcuauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggccuggucugcuagcgccugccacgacggaauuaauuggcugaccaucggcaucuccgggccugauaacggagcugucgccgugcugaaguauaauggcauuaucacagacaccauuaagagcuggagaaacuacauccuccggacacaagagucugagugugcgugcgugaauggguccuguuucaccauuaugacggauggaccgagcgacggccaggccucuuauaaaaucuuucgcaucgaaaagggcaaagucguuaagagcguggagaugaacgcucccaauuaccauuacgaagagugcuccuguuauccugauucuagcgagauuacaugcgugugcagagacaacuggcacggguccaaucggcccugggucagcuucaaccagaaucuggaauaccagaucggauauauuuguucuggcaucuuuggggauaacccucgccccaaugacaaaaccggauccugcggcccggugagcucuaacggggccaauggaguuaagggcuucuccuuuaaguacggcaacgggguguggauuggaagaacaaaaagcaucuccucucggaagggcuucgagaugauuugggauccuaacggguggaccggaaccgacaauaacuuuagcaucaaacaagacaucauuggcaucaaugaaugguccggguauucuggcagcuucguccagcaucccgagcuuacaggacuggauuguauucgcccuugcuucuggguggaacucaucagaggccggcccaaggagaacacgauuuggaccuccgggagcucuaucuccuuuuguggaguuaauagcgacacagugggcuggucuuggcccgauggggcugagcugccuuucaccaucgacaaauga

SEQ ID NO: 203755 - RNA, 1410 nt, Artificial Sequence
  derived and/or modified sequence opt5 from neuraminidase__InfluenzaA__AEH59400
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgaacgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggggccaaccggcccuggguguccuucaaucagaaccuggaauaucagaucggauacauuuguagcggcaucuuuggggauaauccucgccccaacgacaaaaccggaucuugcggcccggucuccagcaauggggcuaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcuuacaggacuggauuguauccgcccuugcuucuggguggaacucauuagaggccggcccaaagagaacacgaucuggaccagcggguccagcauuucuuuuuguggaguuaauuccgacacagugggcuggagcuggcccgauggggccgagcugccuuucaccaucgacaaguga

SEQ ID NO: 203756 - RNA, 1410 nt, Artificial Sequence
  derived and/or modified sequence opt5 from neuraminidase__InfluenzaA__AEH59402
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgaaugacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacggggccaaucggcccugggugagcuucaaccagaaucuggaauaucagaucggauacauuuguuccggcaucuuuggggauaacccucgccccaaugacaaaaccggaagcugcggcccggucucuuccaacggggcuaacggagugaagggcuucagcuuuaaguauggcaaugggguuuggauuggaagaacaaaaucuaucuccagccggaacggcuucgagaugauuugggauccuaauggguggaccgaaaccgacaacaauuuuuccaucaagcaagacaucgugggaauuaacgaguggucuggcuacagcggguccuucguccagcaucccgaacuuacaggccuggauuguauccgcccuugcuucuggguggagcucauuagaggacggcccaaagagaauacgaucuggaccucuggcagcuccauuagcuuuugugggguuaacucugacacagugggaugguccuggcccgauggcgccgaacugccuuucaccaucgacaaguga

SEQ ID NO: 203757 - RNA, 1410 nt, Artificial Sequence
  derived and/or modified sequence opt5 from neuraminidase__InfluenzaA__AEH59404
augaaccccaaucagaagaucauuaccaucggcagcgccugcaugacaauugggauggcuaaccugauccuccaaauuggaaauaucaucuccauuuggaucucucacagcauucagcugggcaaccagucccagaucgagacguguaaucaaucugugauuaccuacgaaaacaauacaugggucaaccagaccuauguuaauaucagcaacacaaauuucgccgcggggcagccugugguguccgucaaacuugcuggaaacucuagccugugcccgguguccggcugggccauuuacagcaaggacaauucuaucagaaucggguccaaaggagauguuuuugugauucgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggagguccccuccccuuacaacagccgcuuugaauccguggcuuggucugccagcgcuugccacgacggaauuaacuggcugaccaucggcaucuccgggccggauaauggagccguugcggugcugaaguauaacggcauuaucacagacaccauuaagagcuggagaaauaacauccuccggacacaagagucugagugugccugcgucaauggguccuguuucaccauuaugacggauggacccagcgacggccaggcuucuuacaaaaucuuucgcaucgaaaagggcaaaauugucaagagcguggagaugaacgccccuaauuaucauuacgaagagugcuccuguuaccccgauucuagcgagaucacaugcgugugcagagacaacuggcacggguccaaucggccuuggguuagcuucaaccagaaucuggaauaucagauuggauacaucuguucuggcauuuuuggggauaacccccgcccgaaugacaaaaccggauccugcggcccugugagcucuaacggggcuaauggagugaagggcuucuccuuuaaguauggcaacggggucuggaucggaagaacaaaaagcauuuccucucggaagggcuucgagaugaucugggaucccaacggguggaccggaaccgacaauaacuuuagcaucaaacaagacauugugggcaucaaugaaugguccggguacucuggcagcuucguucagcauccugagcuuacaggacuggauuguauucgccccugcuucuggguggaacucaucagaggccggcccaaggagaacacgauuuggaccuccgggagcucuaucuccuuuuguggagucaauagcgacacagugggcuggucuuggccugauggggccgagcugccguucaccaucgacaaauga

SEQ ID NO: 203758 - RNA, 1410 nt, Artificial Sequence
  derived and/or modified sequence opt5 from neuraminidase__InfluenzaA__AEH59406
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccacauaucauuacgaagagugcucuuguuacccugauagcuccgagauuaccugcguuugcagagacaauuggcacgggagcaaccggcccugggugucuuucaaucagaaccuggaauaucagaucggauacaucuguuccggcauuuuuggggauaauccucgccccaacgacaaaacaggaagcugcggcccggugucuuucaauggggccaacggagucaagggcuuuuccuucaaguauggcaaugggguguggaucggaagaaccaaaagcauuuccucucggaagggcuuugagaugaucugggauccuaacggguggaccggaacagacaacaauuucagcaucaaacaagacauuguuggcaucgaugaaugguccggguacucuggcagcuucgugcagcaucccgagcuuacgggacuggacuguauucgcccuugcuuuugggucgaacucaucagaggccggcccaaggagaacaccauuuggacauccgggagcucuaucuccuucuguggagugaauagcgauaccguuggcuggucuuggcccgacggggcugagcugccuuuuacaaucgauaaauga

SEQ ID NO: 203759 - RNA, 1410 nt, Artificial Sequence; identical to SEQ ID NO: 203281
  derived and/or modified sequence opt5 from neuraminidase__InfluenzaA__AEH59408

SEQ ID NO: 203760 - RNA, 1410 nt, Artificial Sequence
  derived and/or modified sequence opt5 from neuraminidase__InfluenzaA__AEH59412
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuagaucuuggcggaauaacauccuccgcacacaagaguccgagugugcgugcgugaaugggagcuguuucaccauuaugacggauggaccgucugacggccaggccagcuacaagaucuuuagaaucgaaaaaggcaagauuaucaaauccguggagaugaacgcucccaauuaucauuacgaagagugcucuuguuacccugauagcuccgagauuacaugcgucugccgggacaacuggcacgggagcaaucgccccuggguuucuuucaaccagaaucuggaauaucagaucggauacauuuguuccggcaucuuuggggauaacccuagacccaaugacaagaccggaagcugcggcccggugcuuucuaacggggccaauggagugaaaggcuucuccuuuaaguauggcaacggggucuggauuggacggacaaagagcaucuccucucgcaaaggcuucgagaugaucugggauccuaacggguggaccggaaccgacaauaacuuuagcauuaagcaagacaucgugggcauuaaugaaugguccggguacucuggcagcuucguucagcaucccgagcugacaggacucgauuguaucagaccuugcuucuggguggaacugauucggggccgccccaaagagaacacgaucuggaccuccgggagcucuaucuccuuuuguggagucaauagcgacacagugggcuggucuuggcccgauggggcugagcuuccuuucaccauugacaaguga

SEQ ID NO: 203761 - RNA, 1410 nt, Artificial Sequence; identical to SEQ ID NO: 203733
  derived and/or modified sequence opt5 from neuraminidase__InfluenzaA__AEH59416

SEQ ID NO: 203762 - RNA, 1410 nt, Artificial Sequence; identical to SEQ ID NO: 199762
  derived and/or modified sequence opt5 from neuraminidase__InfluenzaA__AEH59584

SEQ ID NO: 203763 - RNA, 1410 nt, Artificial Sequence; identical to SEQ ID NO: 199762
  derived and/or modified sequence opt5 from neuraminidase__InfluenzaA__AEH59586

SEQ ID NO: 203764 - RNA, 1410 nt, Artificial Sequence; identical to SEQ ID NO: 199762
  derived and/or modified sequence opt5 from neuraminidase__InfluenzaA__AEH59588

SEQ ID NO: 203765 - RNA, 1410 nt, Artificial Sequence; identical to SEQ ID NO: 199762
  derived and/or modified sequence opt5 from neuraminidase__InfluenzaA__AEH59592

SEQ ID NO: 203766 - RNA, 1410 nt, Artificial Sequence; identical to SEQ ID NO: 199762
  derived and/or modified sequence opt5 from neuraminidase__InfluenzaA__AEH59594

SEQ ID NO: 203767 - RNA, 1410 nt, Artificial Sequence; identical to SEQ ID NO: 199762
  derived and/or modified sequence opt5 from neuraminidase__InfluenzaA__AEH59596

SEQ ID NO: 203768 - RNA, 1410 nt, Artificial Sequence; identical to SEQ ID NO: 199762
  derived and/or modified sequence opt5 from neuraminidase__InfluenzaA__AEH59598

SEQ ID NO: 203769 - RNA, 1410 nt, Artificial Sequence; identical to SEQ ID NO: 199762
  derived and/or modified sequence opt5 from neuraminidase__InfluenzaA__AEH59600

SEQ ID NO: 203770 - RNA, 1410 nt, Artificial Sequence
  derived and/or modified sequence opt5 from neuraminidase__InfluenzaA__AEH59602
augaaccccaaucagaagaucauuaccaucggcagcgugugcaugacaauugggauggccaaccugauccuccaaauuggaaauaucaucuccauuuggaucucucacagcauucagcugggcucccagaaccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 203771 - RNA, 1410 nt, Artificial Sequence; identical to SEQ ID NO: 199762
  derived and/or modified sequence opt5 from neuraminidase__InfluenzaA__AEH59606

SEQ ID NO: 203772 - RNA, 1410 nt, Artificial Sequence; identical to SEQ ID NO: 199762
  derived and/or modified sequence opt5 from neuraminidase__InfluenzaA__AEH59616

SEQ ID NO: 203773 - RNA, 1410 nt, Artificial Sequence; identical to SEQ ID NO: 199762
  derived and/or modified sequence opt5 from neuraminidase__InfluenzaA__AEH59626

SEQ ID NO: 203774 - RNA, 1413 nt, Artificial Sequence; identical to SEQ ID NO: 200485
  derived and/or modified sequence opt5 from neuraminidase__InfluenzaA__AEH77262

SEQ ID NO: 203775 - RNA, 1410 nt, Artificial Sequence
  derived and/or modified sequence opt5 from neuraminidase__InfluenzaA__AEH77273
augaaccccaaucagaagaucauuaccaucggcagcgugugcaugacaauugggauggccaaccugauccuccaaauuggaaauaucacguccaucuggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 203776 - RNA, 1410 nt, Artificial Sequence
  derived and/or modified sequence opt5 from neuraminidase__InfluenzaA__AEH77282
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuugucgaggagggcaagaucguucacaucagcacccuuuccgggucugcccaacauguggaagagugcagcuguuacccuagauaucccggagugcggugcgucugucgcgacaacuggaagggcuccaauagaccuauuguggauaucaacguuaaagacuacagcauugugucuuccuacgucugcagcggccuggugggggacacaccccggaagaaugauucuagcuccucuagccacugucucgacccgaacaaugaagagggaggccaugggguuaaaggaugggcuuucgaugacggcaacgauguguggauggggcgcaccaucuccgaaaagcugagaagcggauaugagacguuuaaagucauugagggcuggucuaagccuaauuccaaacugcagaucaaccgccaggugaucgucgaacggggcaauagaagcggguacucuggaauuuucuccguggagggcaagagcugcaucaaccgguguuuuuauguugaacucauuagagggcgcaaggaggaaacagaggugugguggaccuccaauucuaucgucguguucugcggaaccagcggcacauacgggaccggcuccuggcccgacggagccgauauuaaccugaugccuaucuga

SEQ ID NO: 203777 - RNA, 1410 nt, Artificial Sequence; identical to SEQ ID NO: 199762
  derived and/or modified sequence opt5 from neuraminidase__InfluenzaA__AEI29218

SEQ ID NO: 203778 - RNA, 1410 nt, Artificial Sequence; identical to SEQ ID NO: 201129
  derived and/or modified sequence opt5 from neuraminidase__InfluenzaA__AEI29228

SEQ ID NO: 203779 - RNA, 1410 nt, Artificial Sequence; identical to SEQ ID NO: 197161
  derived and/or modified sequence opt5 from neuraminidase__InfluenzaA__AEI54350

SEQ ID NO: 203780 - RNA, 1410 nt, Artificial Sequence; identical to SEQ ID NO: 197174
  derived and/or modified sequence opt5 from neuraminidase__InfluenzaA__AEI54361

SEQ ID NO: 203781 - RNA, 1410 nt, Artificial Sequence; identical to SEQ ID NO: 197738
  derived and/or modified sequence opt5 from neuraminidase__InfluenzaA__AEI54372

SEQ ID NO: 203782 - RNA, 1410 nt, Artificial Sequence; identical to SEQ ID NO: 197615
  derived and/or modified sequence opt5 from neuraminidase__InfluenzaA__AEI54383

SEQ ID NO: 203783 - RNA, 1410 nt, Artificial Sequence; identical to SEQ ID NO: 197738
  derived and/or modified sequence opt5 from neuraminidase__InfluenzaA__AEI54394

SEQ ID NO: 203784 - RNA, 1410 nt, Artificial Sequence; identical to SEQ ID NO: 198908
  derived and/or modified sequence opt5 from neuraminidase__InfluenzaA__AEI54416

SEQ ID NO: 203785 - RNA, 1410 nt, Artificial Sequence; identical to SEQ ID NO: 203728
  derived and/or modified sequence opt5 from neuraminidase__InfluenzaA__AEI54427

SEQ ID NO: 203786 - RNA, 1410 nt, Artificial Sequence; identical to SEQ ID NO: 202542
  derived and/or modified sequence opt5 from neuraminidase__InfluenzaA__AEI54438

SEQ ID NO: 203787 - RNA, 1410 nt, Artificial Sequence; identical to SEQ ID NO: 202542
  derived and/or modified sequence opt5 from neuraminidase__InfluenzaA__AEI54449

SEQ ID NO: 203788 - RNA, 1410 nt, Artificial Sequence; identical to SEQ ID NO: 202542
  derived and/or modified sequence opt5 from neuraminidase__InfluenzaA__AEI54460

SEQ ID NO: 203789 - RNA, 1410 nt, Artificial Sequence
  derived and/or modified sequence opt5 from neuraminidase__InfluenzaA__AEI54471
augaaccccaaucagaagaucauuaccaucggcagcgugucccugacaauuucuacgaucugcuucuuuaugcaaauugccguccucaucaccacaguuacccugcacuucaaacaguacaaguuuaacagcccuccgaauaaccaggugaugcuuugugagcccacaaucauugaaagaaauaucaccgagauuguguaucugacaaacaccacgaucgaaaaagagauuugcccuaagcucgcugaauaccggaauugguccaaaccccagugugacaucaccggguucgccccuuuuucuaaggauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugagcugggcguccccuuucaccucgggaccaaacaggugugcaucgccugguccagcagcuccugucaugacggaaaggccuggcugcacguuugcauuacaggcgaugacaaaaacgcuaccgccagcuucaucuacaauggccggcuuguggauucugucguguccuggagcaaggaaauucugcgcacccaggagucugaaugugugugcaucaacgggacauguacggucguuaugaccgacggauccgcuagcggcaaagccgauacaaagauucucuuuaucgaggaggggaagaucgugcauaccuccacacugucuggaagcgcgcaacacguggaagagugcuccugcuauccuagauaccccggcguccggugugugugccgcgacaacuggaaagggagcaauagaccuauuguugauaucaacauuaaggaccacucuaucguguccagcuacgucuguucuggacuugugggcgacacgccccggaaaaaugauagcuccucuagcucccauugccuggacccgaacaaugaagagggcgggcacggaguuaagggcugggccuucgaugacgggaacgauguguggaugggacgcaccauuaaugaaacaagcagacucggcuaugagaccuuuaaagucaucgagggguggucuaacccuaaguccaaacugcagaucaaucgccaggugauugucgaccggggaaacagaagcggcuacucuggcaucuucuccguggaagggaagucuuguauuaaucggugcuuuuauguugagcugaucagaggacgcaaggaagagaccgaagugcucuggacauccaacucuauugucguguucuguggcaccagcgggacauacggaacgggcuccuggcccgauggggcugaccugaaucuuaugccuaucuga

SEQ ID NO: 203790 - RNA, 1410 nt, Artificial Sequence; identical to SEQ ID NO: 202434
  derived and/or modified sequence opt5 from neuraminidase__InfluenzaA__AEI54482

SEQ ID NO: 203791 - RNA, 1410 nt, Artificial Sequence
  derived and/or modified sequence opt5 from neuraminidase__InfluenzaA__AEI54493
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucucuggacauccaacucuaucguggucuucuguggcaccagcgggacauacggaacgggcuccuggcccgauggggcugaccugaaucuuaugucuauuuga

SEQ ID NO: 203792 - RNA, 1410 nt, Artificial Sequence; identical to SEQ ID NO: 202542
  derived and/or modified sequence opt5 from neuraminidase__InfluenzaA__AEI54504

SEQ ID NO: 203793 - RNA, 1410 nt, Artificial Sequence; identical to SEQ ID NO: 202062
  derived and/or modified sequence opt5 from neuraminidase__InfluenzaA__AEI59982

SEQ ID NO: 203794 - RNA, 1413 nt, Artificial Sequence; identical to SEQ ID NO: 202960
  derived and/or modified sequence opt5 from neuraminidase__InfluenzaA__AEI59993

SEQ ID NO: 203795 - RNA, 1413 nt, Artificial Sequence; identical to SEQ ID NO: 202956
  derived and/or modified sequence opt5 from neuraminidase__InfluenzaA__AEI60004

SEQ ID NO: 203796 - RNA, 1410 nt, Artificial Sequence
  derived and/or modified sequence opt5 from neuraminidase__InfluenzaA__AEI60015
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcggccauugccuggacccgaacaaugaggaagggggaaacggcgugaaagggugggccuucgaugacggaaaugauguuuggaugggccgcaccaucuccgagaagucuagacucggguaugagacauuuaaagugaucgaaggauggucuaaccacaaguccaaacugcagauuaaucggcaggucaucguggaccgcggcaacagaagcggcuacucugggauuuucuccgucgagggaaagagcuguaucaaucggugcuuuuauguggaacugauuagaggccgcaaggaggaaaccgagguucucuggaccuccaacucuaucguggucuucugugggacaagcggaaccuacggcacaggguccuggccugauggcgcugaccugaaucuuaugcccauuuga

SEQ ID NO: 203797 - RNA, 1410 nt, Artificial Sequence; identical to SEQ ID NO: 201508
  derived and/or modified sequence opt5 from neuraminidase__InfluenzaA__AEI60026

SEQ ID NO: 203798 - RNA, 1410 nt, Artificial Sequence
  derived and/or modified sequence opt5 from neuraminidase__InfluenzaA__AEI60037
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggcgcaaugauagcuccucuagcucccauugccuggacccgaacaaugaggaaggcgggcacggagugaagggcugggccuucgaugacgggaacgauguuuggaugggaagaaccaucagcgagaaaucucggcucggcuaugagacauuuaaggugaucgaagggugguccaaucauaaaagcaagcugcagauuaaccgccaggucaucguggacagaggaaaucggucuggcuacuccggcauuuucagcgucgaggggaaauccuguaucaacagaugcuuuuauguggaacugauucgcggacggaaggaggaaaccgagguucucuggaccucuaauagcaucguggucuucuguggcacauccgggaccuacggaacaggcucuuggccugauggggcugaccugaaccuuaugcccauuuga

SEQ ID NO: 203799 - RNA, 1410 nt, Artificial Sequence
  derived and/or modified sequence opt5 from neuraminidase__InfluenzaA__AEI60048
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugcucccacaauuaucgaaagaaauauuaccgagaucguguaucugacaaacaccacgauugaaaaggagaucugcccuaaacucgccgaauaccggaauugguccaagccccagugugacauuaccggguucgcgccuuuuucuaaagauaacagcauccgccuguccgcuggaggcgacaucugggugacaagagagcccuaugucucuugcgauccugacaaguguuaccaauucgcccuugggcagggaaccacacugaauaacgugcauagcaauaacaccguucgggaucgcacgccguauagaacacuccugaugaaugagcugggcgugcccuuucaccucgggaccaagcaggucugcauugccugguccucuagcuccugucaugacggaaaggcuuggcugcacgugugcaucacaggcgaugacaaaaacgccaccgcuagcuucauuuacaauggccggcuuguugauucuguggucuccuggagcaaagaaauccugcgcacccaggagucugaaugugugugcauuaacgggacauguacgguggucaugaccgacggauccgccagcggcaaggcggauacaaaaauccucuuuaucgaggaggggaagauuguucauaccuccacacugucuggaagcgcccaacacguggaagagugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaagagggcgggcacggagugaaaggcugggcuuucgaugacgggaacgauguuuggaugggacgcaccaucagcgaaaagucuagacucggcuaugagacauuuaaagugaucgaggggugguccaauccuaagagcaaacugcagauuaaccggcaggucaucguggaccgcggaaauagaucuggcuacuccggcauuuucagcgucgaagggaaguccuguaucaaccggugcuuuuauguggagcugauuagaggacgcaaggaagagaccgaaguucucuggaccucuaauagcaucguggucuucuguggcacauccgggaccuacggaacaggcucuuggcccgauggggccgacauuaaccugaugccuaucuga

SEQ ID NO: 203800 - RNA, 1410 nt, Artificial Sequence
  derived and/or modified sequence opt5 from neuraminidase__InfluenzaA__AEI60089
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuauuacuacgaagagugcuccuguuauccugauucuagcgagaucacaugcguuugcagagacaauuggcauggguccaaccggcccugggugagcuucaaucagaaccuggaauaccagauuggauauaucuguucuggcauuuuuggggauaauccucgccccaacgacaaaaccggauccugcggcccggugagcucuaauggggccaacggagucaagggcuucuccuuuaaguacggcaacgggguguggaucggaagaacaaaaagcauuuccucucggaagggcuucgagaugaucugggauccuaauggguggaccggaaccgacaacaauuuuagcaucaaacaagacauuguuggcaucaacgaaugguccggguauucuggcagcuucgugcagcaccccgagcuuacaggacuggauuguauucgcccuugcuucugggucgaacucaucagaggccggcccaaggagaauacgauuuggaccuccgggagcucuaucuccuuuuguggagugaacagcgacacaguuggcuggucuuggcccgauggggcugagcugccuuucaccaucgacaaauga

SEQ ID NO: 203801 - RNA, 1410 nt, Artificial Sequence; identical to SEQ ID NO: 203733
  derived and/or modified sequence opt5 from neuraminidase__InfluenzaA__AEI60099

SEQ ID NO: 203802 - RNA, 1410 nt, Artificial Sequence
  derived and/or modified sequence opt5 from neuraminidase__InfluenzaA__AEI60111
augaaccccaaucagaagaucauuaccaucggcagcauuucccugacaaucgccacgauuugcuuccucaugcaaaucgcuauccuggugaccacagucacccuucacuuuaaacaguacaaguguaacucuccuccgaauaacagaguuaugcugugcgagcccacaauuaucgaacggaauauuaccgagaucguguaucucacaaacaccacgauugaaaaagagaucuguccuaagcuggccgaauaccgcaauuggagcaaaccccagugcaacauuaagggguucgcgccuuuuuccaaggacaauucuaucagacuuagcgcuggaggcgauaucugggugacccgggagcccuaugucuccugugacccugauaaaugcuaccaguucgcccuggggcaaggaacaacccucaacaauggccauucuaacgacacagugcacgaucgcaccccguauagaacgcugcugaugaaugagcucgggguucccuuucaucugggaacacgccagguguguauugccuggagcuccagcucuugccacgacggcaaggcuuggcuucaugucuguaucaccggcgaugacgaaaacgccacagcuuccuucauuuacaaugggcggcugguggauagcaucggaucuugguccaaaaagauucucagaacccaggagagcgaaugcguuuguaucaacgggaccugcacaguggucaugacggacggcucugccuccggaaaagcggauaccaagauccuguuuauugaggagggcaagaucgugcacauuagcacacuuuccgggucugcccagcacguggaagagugcagcuguuauccucgguaccccggaguccgcugcguuuguagagacaacuggaaaggcuccaaucggccuaucguggauauuaacgugcgcgacuacagcaucgucucuuccuaugugugcagcggccugguuggggacacccccagaaagaaugauucuuucagcuccucucauugucucgacccgaacaaugaagagggaggccacggggugaaaggaugggcuuuugaugacggcaacgaugucuggauggggcggacaaucagcgaaaagcugcgcuccggauacgagaccuucaaagugauugagggcuggagcaagccuaauucuaaacugcaaguuaacagacaggugaucgucgaacggggcaauagauccggguauagcggaaucuuuucuguggagggcaaguccugcauuaaccgcuguuucuacgucgaacucauucgggggagaaaggaggaaacgaaagugugguggacaagcaauuccaucguuguguuuugcggaaccucuggcaccuaugggacaggcagcuggcccgacggagccgauauuaacaucaugccuaucuga

SEQ ID NO: 203803 - RNA, 1410 nt, Artificial Sequence; identical to SEQ ID NO: 199762
  derived and/or modified sequence opt5 from neuraminidase__InfluenzaA__AEI73669

SEQ ID NO: 203804 - RNA, 1410 nt, Artificial Sequence
  derived and/or modified sequence opt5 from neuraminidase__InfluenzaA__AEI86727
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagcaaguuugaauccguugccuggucugcuagcgccugccacgacggaaucuccuggcugaccaucggcauuagcgggccugauaauggagcuguggccguccugaaguauaacggcaucauuacagacaccaucaaaucuuggcgcaauaacauucucagaacacaagaguccgagugugcgugcgugaaugggagcuguuucaccgugaugacggauggaccgucugacggccaggccagcuacaagaucuuucggaucgaaaaaggcaagauugucaaauccguugagaugaacgcucccaauuaucauuacgaagagugcucuuguuacccugauagcuccgagaucacaugcgugugccgcgacaacuggcacgggagcaauagacccugggugucuuucaaccagaaucuggaauaucagauuggauacaucuguuccggcauuuuuggggauaacccucggcccaaugacaagaccggaagcugcggcccggucucuuccaacggggccaauggagugaagggcuucagcuuuaaauauggcaacgggguuuggaucggacgcacaaaguccauuucuagcagaaacggcuucgagaugaucugggauccuaauggguggaccggaaccgacaacaauuuuuccaucaaacaagacauugugggcaucaacgaauggucuggguacagcggcuccuucguccagcaucccgagcuuacaggacuggauuguauucggccuugcuucuggguggaacucauccgcggcagacccaaggagaauacgauuuggaccagcgggucuuccaucagcuuuuguggaguuaacucugacacagugggcugguccuggcccgauggggcugagcugccuuucaccaucgacaaauga

SEQ ID NO: 203805 - RNA, 1410 nt, Artificial Sequence
  derived and/or modified sequence opt5 from neuraminidase__InfluenzaA__AEI86737
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaaaacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaauggcaccauuaaggauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaaaagcuggagaaauaacauccuccggacacaagagucugagugugcgugcgugaauggguccuguuucaccgugaugacggauggaccgagcgacggccaggccucuuacaagauuuuucgcaucgaaaaaggcaaggucguuaaaagcguggagaugaacgcucccaauuaucauuacgaagagugcuccuguuacccugauucuagcgagaucacaugcgugugcagagacaacuggcacggguccaaucggcccugggucagcuucaaccagaaucuggaauaucagauuggauacaucuguucuggcauuuuuggggauaacccucgccccaaugacaagaccggauccugcggcccggugagcucuaacggggccaauggaguuaagggcuucuccuuuaaauauggcaacgggguguggaucggaagaacaaagagcauuuccucucggaacggcuucgagaugaucugggauccuaauggguggaccggaaccgacaacaauuuuagcauuaaacaagacaucgucggcaucaacgaaugguccggguacucuggcagcuucgugcagcaucccgagcuuacaggacuggauuguauucgcccuugcuucuggguugaacucaucagaggccggcccaaggagaauacgauuuggaccuccgggagcucuaucuccuuuuguggagugaacagcgacacagucggcuggucuuggcccgauggggcugagcugccuuucaccauugacaaauga

SEQ ID NO: 203806 - RNA, 1410 nt, Artificial Sequence
  derived and/or modified sequence opt5 from neuraminidase__InfluenzaA__AEI86757
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuaucucucggaacggcuucgagaugaucugggauccuaauggguggaccggaaccgacaacaauuuuagcauuaagcaagacaucgugggcauuaacgaaugguccggguacucuggcagcuucguccagcaucccgagcuuacaggacuggauuguauccgcccuugcuucuggguggaacucauuagaggccggcccaaagagaauacgaucuggaccuccgggagcucuaucuccuuuuguggaguuaacagcgacacagugggcuggucuuggcccgauggggcugagcugccuuucaccauugacaaguga

SEQ ID NO: 203807 - RNA, 1410 nt, Artificial Sequence
  derived and/or modified sequence opt5 from neuraminidase__InfluenzaA__AEI86767
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccauaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuucuagccggaacggcuucgagaugaucugggauccuaauggguggaccggaaccgacaacaauuuuuccaucaagcaggacauugugggcaucaacgaauggucuggguacagcggcuccuucguccaacaccccgagcuuacaggacuggauuguauucgcccuugcuucuggguggaacucaucagaggccggcccaaagagaauacgauuuggaccagcgggucuuccaucagcuuuuguggaguuaacucugacacagugggcugguccuggcccgauggggcugagcugccuuucaccaucgacaaguga

SEQ ID NO: 203808 - RNA, 1410 nt, Artificial Sequence; identical to SEQ ID NO: 203807
  derived and/or modified sequence opt5 from neuraminidase__InfluenzaA__AEI86777

SEQ ID NO: 203809 - RNA, 1410 nt, Artificial Sequence
  derived and/or modified sequence opt5 from neuraminidase__InfluenzaA__AEI86787
augaaccccaaucagaagaucauuaccaucggcagcgugugcaugacaauugggauggccaaccugaugcuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 203810 - RNA, 1410 nt, Artificial Sequence
  derived and/or modified sequence opt5 from neuraminidase__InfluenzaA__AEI86797
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuucuagccggaacggcuucgagaugaucugggauccuaauggguggaccggaaccgacaacaauuuuuccaucaagcaagacauugugggcaucaacgaauggucuggguacagcggcuccuucguccagcaucccgagcuuacaggacuggauuguauucgcccuugcuucuggguggaacucaucagaggccggcccaaagagaauacgauuuggaccagcgggucuuccaucagcuuuuguggaguuaacucugacacagugggcugguccuggcccgauggggcugagcugccuuucaccaucgacaaguga

SEQ ID NO: 203811 - RNA, 1410 nt, Artificial Sequence
  derived and/or modified sequence opt5 from neuraminidase__InfluenzaA__AEI86807
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcaaaauuacaugcgugugcagagacaauuggcacggguccaaccggcccugggugagcuucaaucagaaccuggaguaucagaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgaaaugauuugggauccuaacggguggaccggaaccgacaauaacuuuagcaucaaacaagacaucgugggcauuaaugagugguccggguacucuggcagcuucguccagcaucccgaacuuacaggacuggauuguauccgcccuugcuucuggguggagcucauuagaggccggcccaaggaaaacacgaucuggaccuccgggagcucuauuuccuuuuguggaguuaauagcgacacagugggcuggucuuggcccgauggggcugagcugccuuucaucaucgacaaauga

SEQ ID NO: 203812 - RNA, 1410 nt, Artificial Sequence; identical to SEQ ID NO: 203807
  derived and/or modified sequence opt5 from neuraminidase__InfluenzaA__AEI86817

SEQ ID NO: 203813 - RNA, 1410 nt, Artificial Sequence
  derived and/or modified sequence opt5 from neuraminidase__InfluenzaA__AEI86827
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccauaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccaccucuagccggaacggcuucgagaugauuugggauccuaauggguggaccggaacagacaacaauuuuuccaucaagcaggacaucgugggcauuaacgaauggucuggguacagcggcuccuucguccaacaccccgagcuuacgggacugaauuguauccgcccuugcuucuggguggaacucauuagaggccggcccaaagagaacaccaucuggacaagcgggucuuccauuagcuuuuguggaguuaauucugauaccgugggcugguccuggcccgacggggcugagcugccuuucacaaucgauaaguga

SEQ ID NO: 203814 - RNA, 1410 nt, Artificial Sequence; identical to SEQ ID NO: 203810
  derived and/or modified sequence opt5 from neuraminidase__InfluenzaA__AEI86837

SEQ ID NO: 203815 - RNA, 1410 nt, Artificial Sequence; identical to SEQ ID NO: 203281
  derived and/or modified sequence opt5 from neuraminidase__InfluenzaA__AEI86847

SEQ ID NO: 203816 - RNA, 1410 nt, Artificial Sequence
  derived and/or modified sequence opt5 from neuraminidase__InfluenzaA__AEI86867
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaaccuugcugccgggcagagcguggucuccgugaaacuggcgggaaauucuagccucugcccuguuuccggcugggcuauuuacagcaaggacaacucuaucagaaucggguccaaaggagauguguucgucauucgggagccguuuaucagcuguucuccccuggaaugccgcaccuucuuucuuacacagggcgcccugcucaaugacaagcauuccaacggcaccauuaaagauagaagcccuuaucggacgcugaugucuugucccaucggggaggugccuucccccuacaacagcaaguucgaauccguugccuggucugcuagcgccugccacgacggaauuaauuggcugaccaucggcaucuccgggccugauaacggagcuguggccguccucaaguauaauggcauuaucacagacaccauuaaaagcuggcgcaacaauauccugagaacacaagagucugagugugcgugcgugaacggguccuguuuuaccauuaugacggauggaccgagcgacggccaggccucuuacaagaucuuccggaucgaaaaaggcaagauugugaaaagcgucgagaugaaugcucccaacuaucauuacgaagagugcuccuguuacccugauucuagcgagaucacaugcguuugccgcgacaauuggcacggguccaacagacccugggugagcuuuaaucagaaccuugaauaucagauuggauacaucuguucuggcauuuucggggauaauccucggcccaacgacaagaccggauccugcggcccggugagcucuaauggggccaacggagucaagggcuuuuccuucaaauauggcaacgggguguggaucggacgcacaaagagcauuuccucuagaaaaggcuuugagaugaucugggauccuaauggguggaccggaaccgacaacaauuucagcaucaagcaagacauuguuggcaucaacgaaugguccggguacucuggcagcuuugugcagcaucccgagcugacaggacucgauuguauucggccuugcuucugggucgaacugauccgcggcagacccaaagagaauacgauuuggaccuccgggagcucuaucuccuucuguggagugaacagcgacacaguuggcuggucuuggcccgauggggcugagcuuccuuuuaccaucgacaaguga

SEQ ID NO: 203817 - RNA, 1410 nt, Artificial Sequence; identical to SEQ ID NO: 203810
  derived and/or modified sequence opt5 from neuraminidase__InfluenzaA__AEI86887

SEQ ID NO: 203818 - RNA, 1410 nt, Artificial Sequence; identical to SEQ ID NO: 203810
  derived and/or modified sequence opt5 from neuraminidase__InfluenzaA__AEI86897

SEQ ID NO: 203819 - RNA, 1410 nt, Artificial Sequence
  derived and/or modified sequence opt5 from neuraminidase__InfluenzaA__AEI86907
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacauucauuccaacggcaccaucaaggauagaagcccuuaucggacgcucaugucuugucccauuggggaggugccuucccccuacaacagccgcuuugaauccguugccuggucugcuagcgccugccacgacggaaucaauuggcugaccaucggcauuuccgggccugauaacggagcuguggccguccugaaauauaauggcaucauuacagacaccaucaagagcuggagaaacaauauucuccggacacaagagucugagugugcgugcgugaacggguccuguuucaccaucaugacggauggaccgagcgacggccaggccucuuacaagaucuuucgcauugaaaaaggcaagaucgugaaaagcgucgagaugaaugcucccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaagaccggauccugcggcccggugagcucuaauggggccaacggagucaaaggcuucuccuuuaaguauggcaacgggguguggauuggaagaacaaagagcaucuccucucggaaaggcuucgagaugaucugggauccuaauggguggaccggaaccgacaacaauuuuagcauuaagcaagacaucguuggcauuaacgaaugguccggguacucuggcagcuucgugcagcaucccgagcuuacaggacuggauuguauccgcccuugcuucugggucgaacucauuagaggccggcccaaagagaauacgaucuggaccuccgggagcucuaucuccuuuuguggagugaacagcgacacaguuggcuggucuuggcccgauggggcugagcugccuuucaccauugacaaguga

SEQ ID NO: 203820 - RNA, 1410 nt, Artificial Sequence
  derived and/or modified sequence opt5 from neuraminidase__InfluenzaA__AEI86917
augaaccccaaucagaagaucauuaccaucggcagcauuugcaugacaaucgggauggccaaccugauucuccaaaucggaaauaucauuuccaucuggauuucucacagcauccagcugggcaaccagaaucagauugagacguguaaccaauccgugaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccaucaugacggauggaccgagcgacggccaggccucuuacaaaaucuuucgcauugaaaagggcaaaaucgucaagagcguggagaugaaugcucccaacuaucauuacgaagagugcuccuguuacccugauucuagcgagauuacaugcgugugcagagacaauuggcacggguccaaccggcccuggguuagcuucaaucagaaccuggaauaucagaucggauacauuuguucuggcaucuuuggggauaauccucgccccaacgacaaaaccggauccugcggcccggugagcucuaauggggccaacggagugaagggcuucuccuuuaaguauggcaacggggucuggauuggaagaacaaaaagcaucuccucucggaagggcuucgagaugaucugggauccuaauggguggaccggaaccgacaacaauuuuagcauuaaacaagacaucgugggcauuaacgaaugguccggguacucuggcagcuucguucagcaucccgagcuuacaggacuggauuguauccgcccuugcuucuggguggaacucauuagaggccggcccaaggagaauacgaucuggaccuccgggagcucuaucuccuuuuguggagucaacagcgacacagugggcuggucuuggcccgauggggcugagcugccuuucaccauugacaaauga

SEQ ID NO: 203821 - RNA, 1410 nt, Artificial Sequence; identical to SEQ ID NO: 203733
  derived and/or modified sequence opt5 from neuraminidase__InfluenzaA__AEI86927

SEQ ID NO: 203822 - RNA, 1410 nt, Artificial Sequence; identical to SEQ ID NO: 203807
  derived and/or modified sequence opt5 from neuraminidase__InfluenzaA__AEI86937

SEQ ID NO: 203823 - RNA, 1410 nt, Artificial Sequence
  derived and/or modified sequence opt5 from neuraminidase__InfluenzaA__AEI86947
augaaccccaaucagaagaucauuaccaucggcagcgugugcaugacaauugggauggccaaccugauccuccaaauuggaaauaucaucuccauuuggaucucucacagcauucagcugggcaacaaaaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcaccuuuuuccugacacagggcgcccuucugaaugacaaacauuccaacggcaccauuaaggauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaaaagcuggagaaacaauauccuccggacacaggagucugagugugcgugcgugaacggguccuguuucaccgugaugacggauggaccgagcgacggccaagccucuuacaagauuuuucgcaucgaaaaaggcaagaucgucaaaagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgagaugauuugggauccuaacggguggaccggaaccgacaauaacuuuagcaucaaacaggacaucgugggcauuaaggaaugguccggguacucuggcagcuucguccaacaucccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 203824 - RNA, 1410 nt, Artificial Sequence
  derived and/or modified sequence opt5 from neuraminidase__InfluenzaA__AEI86967
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagaugccuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccauuaugacggauggaccgagcgacggccaggcuucuuacaaaaucuuucgcaucgaaaagggcaaaauugucaagagcguggagaugaaugcccccaacuaucauuacgaagagugcuccuguuacccugauucuagcgagaucacaugcgugugcagagacaauuggcacggguccaaccggcccuggguuagcuucaaucagaaccuggaauaucagauuggauacaucuguucuggcauuuuuggggauaauccucgccccaacgacaaaaccggauccugcggcccggugagcucuaauggggcuaacggagugaagggcuucuccuuuaaguauggcaacggggucuggaucggaagaacaaaaagcauuuccucucggaagggcuucgagaugaucugggauccuaauggguggaccggaaccgacaacaauuuuagcaucaaacaagacauugugggcaucaacgaaugguccggguacucuggcagcuucguucagcaucccgagcuuacaggacuggauuguauucgcccuugcuucuggguggaacucaucagaggccggcccaaggagaauacgauuuggaccuccgggagcucuaucuccuuuuguggagucaacagcgacacagugggcuggucuuggcccgauggggccgagcugccuuucaccaucgacaaauga

SEQ ID NO: 203825 - RNA, 1410 nt, Artificial Sequence
  derived and/or modified sequence opt5 from neuraminidase__InfluenzaA__AEI86977
augaaccccaaucagaagaucauuaccaucggcagcgugugcaugacaauugggauggccaaccugauccuccaaauuggaaauaucaucuccauuuggaucucucacagcauucagcugggcaaccagaaucagaucgggacguguaaccaauccgucauuaccuacgagaauaacacauggguuaaucagaccuaugugaacaucucuaauacaaacuucgcugccggacagagcguggucuccgugaaacuugcgggcaauucuagccugugcccuguuuccgggugggcuauuuacagcaaggacaacucuaucagaaucggauccaaaggcgauguguuugucauucgggaaccguucaucagcuguucuccccucgagugccgcaccuuuuuccugacacagggcgcccuucugaaugacaagcauuccaacgggaccauuaaagauagaagcccuuaucggacgcucaugucuugucccaucggagaagugccuucccccuacaacagccgcuuugaguccguugccuggucugcuagcgccugccacgacggcauuaauuggcugaccaucgggaucuccggaccugauaacggcgcuguggccguccugaaguauaaugggauuaucacagacaccauuaagagcuggagaaacaauauccuccggacacaagaaucugaguguaccugcgugaacggauccuguuucacggugaugacagauggcccgagcgacggccaggcgucuuacaaaauuuuuaagaucgagaaagggaagaucgucaaaagcguugaaaugaaugcccccaacuaucauuacgaggaaugcuccuguuacccugauucuagcgagauuaccugcgugugccgcgacaauuggcacggauccaacagacccugggugagcuucaaucagaaccuggaguaucagaucggcuacauuuguucugggaucuuuggagauaauccucggcccaacgacaagacaggcuccugcgggccggucagcucuaauggagcuaacggcgugaagggcuucuccuuuaaauaugggaacggaguuuggauuggccgcaccaagagcaucuccucuagaaauggguucgaaaugauuugggauccuaacggauggaccggcacagacaauaacuuuagcaucaaacaagacaucguggggauuaaugagugguccggcuacucuggcagcuucguccagcaucccgaacuuacgggacuggauuguauccggccuugcuucuggguggagcucauucgcgggagacccaaggaaaacaccaucuggacauccggaagcucuauuuccuuuuguggcguuaauagcgacaccgugggguggucuuggcccgauggagccgagcugccuuucacaaucgacaaauga

SEQ ID NO: 203826 - RNA, 1410 nt, Artificial Sequence
  derived and/or modified sequence opt5 from neuraminidase__InfluenzaA__AEI86997
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaagaaugguccggguacucuggcagcuucguccagcaucccgagcuuacaggacuggauuguauccgcccuugcuucuggguggaacucauuagaggccggcccaaggagaauacgaucuggaccuccgggagcauuaucucuuuuuguggaguuaacuccgacacagugggcuggagcuggcccgauggggcugagcugccuuucaccaucgacaaauga

SEQ ID NO: 203827 - RNA, 1410 nt, Artificial Sequence
  derived and/or modified sequence opt5 from neuraminidase__InfluenzaA__AEI87007
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuucccucgaaugccgcaccuuuuuccugacacagggcgcccuucugaaugacaagcauagcaacggcaccaucaaagauagaucucccuaucggacgcucauguccuguccuauuggggaggugcccagcccuuacaacucccgcuuugaaucuguugccuggagcgcuuccgccugccacgacggaaucagcuggcugaccaucggcauuucugggcccgauaauggagcuguggccguccugaaguauaacggcaucauuacagacaccaucaaguccuggagaaauaacauucuccggacacaagagagcgagugugcgugcgugaaugggucuuguuucaccgugaugacggauggaccuagcgacggccaggccuccuacaaaaucuuucgcaucgaaaagggcaaaauugucaagucuguugagaugaacgcuccgaauuaucauuacgaagagugcagcuguuaccccgauuccagcgagaucacaugcgugugcagagacaacuggcacgggucuaaucggccuuggguguccuucaaccagaaucuggaauaucagauuggauacaucuguagcggcauuuuuggggauaacccccgcccuaaugacaaaaccggaucuugcggccccgucuccagcaacggggccaauggagugaagggcuucuccuuuaaguauggcaacgggguuuggaucggaagaacaaaaucuauuagcucccggaacggcuucgagaugaucugggauccgaauggguggaccggaaccgacaacaauuuuucuaucaagcaagacauugugggcaucaacgaauggagcggguacuccggcagcuucguccagcauccugagcuuacaggacuggauuguauucgccccugcuucuggguggaacucaucagaggccggccuaaagagaauacgauuuggaccucuggguccagcaucucuuuuuguggaguuaacuccgacacagugggcuggagcuggcccgauggggcugagcugcccuucaccaucgacaaguga

SEQ ID NO: 203828 - RNA, 1410 nt, Artificial Sequence
  derived and/or modified sequence opt5 from neuraminidase__InfluenzaA__AEI87017
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauggcgacacagggggauggagcuggcccgauggcgcugagcugccuuucaccaucgacaaguga

SEQ ID NO: 203829 - RNA, 1410 nt, Artificial Sequence; identical to SEQ ID NO: 203733
  derived and/or modified sequence opt5 from neuraminidase__InfluenzaA__AEI87027

SEQ ID NO: 203830 - RNA, 1410 nt, Artificial Sequence; identical to SEQ ID NO: 203826
  derived and/or modified sequence opt5 from neuraminidase__InfluenzaA__AEI87037

SEQ ID NO: 203831 - RNA, 1410 nt, Artificial Sequence; identical to SEQ ID NO: 203810
  derived and/or modified sequence opt5 from neuraminidase__InfluenzaA__AEI87047

SEQ ID NO: 203832 - RNA, 1410 nt, Artificial Sequence
  derived and/or modified sequence opt5 from neuraminidase__InfluenzaA__AEI87057
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaagaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 203833 - RNA, 1410 nt, Artificial Sequence; identical to SEQ ID NO: 203281
  derived and/or modified sequence opt5 from neuraminidase__InfluenzaA__AEI87067

SEQ ID NO: 203834 - RNA, 1410 nt, Artificial Sequence
  derived and/or modified sequence opt5 from neuraminidase__InfluenzaA__AEI87077
augaaccccaaucagaagaucauuaccaucggcagcauuugcaugacaaucgggauggccaaccugauucuccaaaucggaaauaucauuuccaucuggauuucucacagcauccaguucggcaaccagaaucagauugggacguguaaccaauccgugaucaccuacgagaauaacacaugggucaaucagaccuauguuaacauuucuaauacaaacuuugcugccggacagagcgugguguccgucaaacuggcgggcaauucuagccuuugcccuguguccgggugggcuaucuacagcaaggacaacucuaucagaauuggauccaaaggcgauguuuucgugauccgggaaccguuuauuagcuguucuccccuggagugccgcaccuucuuucucacacagggcgcccugcuuaaugacaagcauuccaacgggaccaucaaagauagaagcccuuaucggacgcugaugucuugucccauuggagaagucccuucccccuacaacagccgcuucgaguccguggccuggucugcuagcgccugccacgacggcaucaauuggcucaccaucgggauuuccggaccugauaacggcgcuguugccgugcugaaguauaaugggaucauuacagacaccaucaagagcuggagaaacaauauucugcggacacaagaaucugagugugcgugcgucaacggauccuguuuuaccaucaugacggauggcccgagcgacggccaggccucuuacaaaaucuuccgcauugagaaggggaaaaucgucaagagcguggaaaugaaugcucccaacuaucauuacgaggaaugcuccuguuacccugauucuagcgagauuacaugcgugugcagagacaauuggcacggauccaaccggcccuggguuagcuuuaaucagaaccucgaguaucagaucggcuacauuuguucugggaucuucggagauaauccucgccccaacgacaaaaccggcuccugcgggccggugagcucuaauggagccaacggcgugaagggcuuuuccuucaaguaugggaacggagucuggauuggcagaacaaaaagcaucuccucucggaagggguuugaaaugaucugggauccuaauggauggaccggcaccgacaacaauuucagcauuaaacaagacaucguggggauuaacgagugguccggcuacucuggcagcuucguucagcaucccgaacugacaggacuugauuguauccgcccuugcuuuuggguggagcugauuagagggcggcccaaggaaaauacgaucuggaccuccggaagcucuaucuccuucuguggcgucaacagcgacacagugggguggucuuggcccgauggagcugagcucccuuuuaccauugacaaauga

SEQ ID NO: 203835 - RNA, 1410 nt, Artificial Sequence
  derived and/or modified sequence opt5 from neuraminidase__InfluenzaA__AEI87087
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuauuuccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaagaaugguccggguacucuggcagcuucgugcagcaucccgagcuuacaggacuggauuguauucgcccuugcuucugggucgaacucaucagaggccggcccaaggagaauacgauuuggaccuccgggagcaucaucucuuuuuguuccgugaacagcgacacaguuggauggucuuggcccgauggcgcugagcugccuuucaccauugacaaauga

SEQ ID NO: 203836 - RNA, 1410 nt, Artificial Sequence; identical to SEQ ID NO: 203807
  derived and/or modified sequence opt5 from neuraminidase__InfluenzaA__AEI87097

SEQ ID NO: 203837 - RNA, 1410 nt, Artificial Sequence; identical to SEQ ID NO: 203807
  derived and/or modified sequence opt5 from neuraminidase__InfluenzaA__AEI87107

SEQ ID NO: 203838 - RNA, 1413 nt, Artificial Sequence
  derived and/or modified sequence opt5 from neuraminidase__InfluenzaA__AEI91968
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcaucaagccuuguuucuggguggagcuuguucgggggcugccccgcgaaaacacaaccauuuggacgagcggauccucuaucagcuucugcggcgucaauuccgauacagccaacuggagcuggccugacggggcugagcuccccuuuaccauugauaaguga

SEQ ID NO: 203839 - RNA, 1410 nt, Artificial Sequence; identical to SEQ ID NO: 199762
  derived and/or modified sequence opt5 from neuraminidase__InfluenzaA__AEI91983

SEQ ID NO: 203840 - RNA, 1410 nt, Artificial Sequence; identical to SEQ ID NO: 202248
  derived and/or modified sequence opt5 from neuraminidase__InfluenzaA__AEI91984

SEQ ID NO: 203841 - RNA, 1410 nt, Artificial Sequence
  derived and/or modified sequence opt5 from neuraminidase__InfluenzaA__AEI92004
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccuauggagugaagggcuucuccuuuaaguacggcaacgggguuuggauuggaagaacaaaaagcaucuccucucggaacggcuucgagaugauuugggauccuaauggguggaccggaaccgacaacaauuuuagcaucaagcaagacaucgugggcauuaacgaaugguccggguauucuggcagcuucguccagcaucccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 203842 - RNA, 1413 nt, Artificial Sequence
  derived and/or modified sequence opt5 from neuraminidase__InfluenzaA__AEI92023
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagaaaauuaucaccuacgagaacuccacaugggugaaucauaccuaugucaacaucaauaacacaaauguuguggccggagaagacaagaccucugugacacuggcgggcaacagcucccuuuguagcauuucugggugggcuaucuacaccaaagauaauuccauuagaaucggaagcaagggcgacgucuucgugauucgggagccuuuuaucucuugcucccaccuggaaugucgcacguucuuucucacccaaggcgcccugcuuaacgauaaacauagcaaugggacaguuaaggacagaucuccguaucgggcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaauauaauggaaucauuacaggcaccaucaagucuuggaaaaagcagauucuccgcacgcaggaguccgagugcguuuguaugaacggcagcugcuuuacaaucaugaccgaugggcccucuaauaaagcugccagcuacaagaucuucaagauugaaaaaggaaaggugacaaaauccaucgagcugaacgcuccuaauuuuuauuacgaagaguguucuugcuacccggacaccggcauugucaugugugugugcagagauaacuggcaugggagcaaucggcccuggguguccuucaaccagaaucuugacuaucaaaucggauacauuugcagcggcgucuuuggggauaacccucgccccgaggacggagaaggcucuuguaauccuguuaccguggauggcacaaacggggugaagggauucuccuauaaauacggcaauggggucuggaucggaagaacgaaguccaaccggcugcgcaaaggcuuugagaugauuugggaccccaauggguggaccaacacagacucugauuucuccgugaagcaggacguuguggccaucaccgauuggagcggcuauuccggaucuuuuguccagcacccggaacucacaggccuggacugcaucagaccuuguuucuggguggagcuuguucgggggcugccccgcgaaaacaccacgauuuggacaagcggauccucuaucagcuucugcggcgugaauagcgauaccgcgaacuggagcuggccugacggggccgagcuccccuuuaccauugauaaguga

SEQ ID NO: 203843 - RNA, 1410 nt, Artificial Sequence
  derived and/or modified sequence opt5 from neuraminidase__InfluenzaA__AEJ10403
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucugccaacggggcuaauggagugaagggcuucuccuuuaaguauggcaacgggguuuggaucggaagaacaaaaagcauuuccucucggaacggcuucgagaugaucugggauccuaauggguggaccggaaccgacaacaauuuuagcaucaagcaagacauugugggcaucaacgaaugguccggguacucuggcagcuucguccagcaucccgagcuuacaggacuggauuguauucgcccuugcuucuggguggaacucaucagaggccggcccaaagagaauacgauuuggaccuccgggagcucuaucuccuuuuguggaguuaacagcgacacagugggcuggucuuggcccgauggggccgagcugccuuucaccaucgacaaguga

SEQ ID NO: 203844 - RNA, 1410 nt, Artificial Sequence; identical to SEQ ID NO: 203810
  derived and/or modified sequence opt5 from neuraminidase__InfluenzaA__AEJ10413

SEQ ID NO: 203845 - RNA, 1410 nt, Artificial Sequence; identical to SEQ ID NO: 203832
  derived and/or modified sequence opt5 from neuraminidase__InfluenzaA__AEJ10423

SEQ ID NO: 203846 - RNA, 1410 nt, Artificial Sequence
  derived and/or modified sequence opt5 from neuraminidase__InfluenzaA__AEJ10433
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucauuggcaucaaugaaugguccggguacucuggcagcuucgugcaacaucccgagcuuacaggacuggauuguauuagaccuugcuucugggucgaacucauccggggccgccccaaagagaacacgauuuggaccuccgggagcucuaucuccuuuuguggagugaauagcggcacaguuggguggucuuggcccgacggagcugagcugccuuucaccaucgauaaguga

SEQ ID NO: 203847 - RNA, 1410 nt, Artificial Sequence; identical to SEQ ID NO: 203281
  derived and/or modified sequence opt5 from neuraminidase__InfluenzaA__AEJ10443

SEQ ID NO: 203848 - RNA, 1410 nt, Artificial Sequence; identical to SEQ ID NO: 203281
  derived and/or modified sequence opt5 from neuraminidase__InfluenzaA__AEJ10453

SEQ ID NO: 203849 - RNA, 1410 nt, Artificial Sequence; identical to SEQ ID NO: 203733
  derived and/or modified sequence opt5 from neuraminidase__InfluenzaA__AEJ10463

SEQ ID NO: 203850 - RNA, 1410 nt, Artificial Sequence
  derived and/or modified sequence opt5 from neuraminidase__InfluenzaA__AEJ10473
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaaaacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaauggcaccauuaaggauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaaaagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaauggagugaagggcuucuccuuuaaauauggcaacgggguuuggauuggaagaacaaagagcaucuccucucggaacggcuucgagaugauuugggauccuaauggguggaccggaaccgacaacaaauuuagcaucaagcaagacaucgugggcauuaaugaaugguccggguacucuggcagcuucguccagcaucccgagcuuacaggacugaacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 203851 - RNA, 1410 nt, Artificial Sequence; identical to SEQ ID NO: 203281
  derived and/or modified sequence opt5 from neuraminidase__InfluenzaA__AEJ10503

SEQ ID NO: 203852 - RNA, 1410 nt, Artificial Sequence; identical to SEQ ID NO: 199762
  derived and/or modified sequence opt5 from neuraminidase__InfluenzaA__AEJ10523

SEQ ID NO: 203853 - RNA, 1410 nt, Artificial Sequence; identical to SEQ ID NO: 199762
  derived and/or modified sequence opt5 from neuraminidase__InfluenzaA__AEJ10533

SEQ ID NO: 203854 - RNA, 1410 nt, Artificial Sequence; identical to SEQ ID NO: 199762
  derived and/or modified sequence opt5 from neuraminidase__InfluenzaA__AEJ10543

SEQ ID NO: 203855 - RNA, 1410 nt, Artificial Sequence; identical to SEQ ID NO: 199762
  derived and/or modified sequence opt5 from neuraminidase__InfluenzaA__AEJ10553

SEQ ID NO: 203856 - RNA, 1410 nt, Artificial Sequence; identical to SEQ ID NO: 202037
  derived and/or modified sequence opt5 from neuraminidase__InfluenzaA__AEJ10563

SEQ ID NO: 203857 - RNA, 1410 nt, Artificial Sequence; identical to SEQ ID NO: 202037
  derived and/or modified sequence opt5 from neuraminidase__InfluenzaA__AEJ10573

SEQ ID NO: 203858 - RNA, 1410 nt, Artificial Sequence; identical to SEQ ID NO: 202037
  derived and/or modified sequence opt5 from neuraminidase__InfluenzaA__AEJ10583

SEQ ID NO: 203859 - RNA, 1410 nt, Artificial Sequence
  derived and/or modified sequence opt5 from neuraminidase__InfluenzaA__AEJ36305
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaccuccucucggaauggcuucgagaugaucugggauccuaacggguggaccggaacagacaauagcuuuuccauuaagcaagacaucgugggcaucaacgaauggucuggguacagcggcuccuucguccagcaucccgagcuuacgggacuggauuguauucgcccuugcuucuggguggaacucaucagaggccggcccaaagagaauaccauuuggacaagcgggucuuccaucagcuuuuguggaguuaacucugacaccgugggcugguccuggcccgauggggcugagcugccuuucacaauugacaaguga

SEQ ID NO: 203860 - RNA, 1410 nt, Artificial Sequence; identical to SEQ ID NO: 199762
  derived and/or modified sequence opt5 from neuraminidase__InfluenzaA__AEJ37856

SEQ ID NO: 203861 - RNA, 1410 nt, Artificial Sequence; identical to SEQ ID NO: 199762
  derived and/or modified sequence opt5 from neuraminidase__InfluenzaA__AEJ37866

SEQ ID NO: 203862 - RNA, 1410 nt, Artificial Sequence; identical to SEQ ID NO: 199762
  derived and/or modified sequence opt5 from neuraminidase__InfluenzaA__AEJ37876

SEQ ID NO: 203863 - RNA, 1410 nt, Artificial Sequence; identical to SEQ ID NO: 203810
  derived and/or modified sequence opt5 from neuraminidase__InfluenzaA__AEJ37886

SEQ ID NO: 203864 - RNA, 1410 nt, Artificial Sequence
  derived and/or modified sequence opt5 from neuraminidase__InfluenzaA__AEJ37896
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcagaauugucaaauccguugagaugaacgcucccaauuaucauuacgaagagugcucuuguuacccugauagcuccgagaucacaugcgugugccgggacaacuggcacgggagcaaucgccccugggugucuuucaaccagaaucuggaauaucagauuggauacaucuguuccggcauuuuuggggauaacccuagacccaaugacaagaccggaagcugcggcccggucucuuccaacggggccaauggagugaaaggcuucagcuuuaaguauggcaacgggguuuggaucggacggacaaaguccauuucuagccgcaacggcuucgagaugaucugggauccuaauggguggaccggaaccgacaacaauuuuuccaucaaacaagacauugugggcaucaacgaauggucuggguacagcggcuccuucguccagcaucccgagcuuacaggacuggauuguauuagaccuugcuucuggguggaacucauccggggccgccccaaggagaauacgauuuggaccagcgggucuuccaucagcuuuuguggaguuaacucugacacagugggcugguccuggcccgauggggcugagcugccuuucaccaucgacaaauga

SEQ ID NO: 203865 - RNA, 1410 nt, Artificial Sequence; identical to SEQ ID NO: 203810
  derived and/or modified sequence opt5 from neuraminidase__InfluenzaA__AEJ37906

SEQ ID NO: 203866 - RNA, 1410 nt, Artificial Sequence; identical to SEQ ID NO: 203810
  derived and/or modified sequence opt5 from neuraminidase__InfluenzaA__AEJ37916

SEQ ID NO: 203867 - RNA, 1410 nt, Artificial Sequence; identical to SEQ ID NO: 203810
  derived and/or modified sequence opt5 from neuraminidase__InfluenzaA__AEJ37926

SEQ ID NO: 203868 - RNA, 1410 nt, Artificial Sequence; identical to SEQ ID NO: 201664
  derived and/or modified sequence opt5 from neuraminidase__InfluenzaA__AEJ37936

SEQ ID NO: 203869 - RNA, 1410 nt, Artificial Sequence; identical to SEQ ID NO: 199762
  derived and/or modified sequence opt5 from neuraminidase__InfluenzaA__AEJ37946

SEQ ID NO: 203870 - RNA, 1410 nt, Artificial Sequence; identical to SEQ ID NO: 203810
  derived and/or modified sequence opt5 from neuraminidase__InfluenzaA__AEJ37956

SEQ ID NO: 203871 - RNA, 1410 nt, Artificial Sequence; identical to SEQ ID NO: 203810
  derived and/or modified sequence opt5 from neuraminidase__InfluenzaA__AEJ37966

SEQ ID NO: 203872 - RNA, 1410 nt, Artificial Sequence; identical to SEQ ID NO: 199762
  derived and/or modified sequence opt5 from neuraminidase__InfluenzaA__AEJ37976

SEQ ID NO: 203873 - RNA, 1410 nt, Artificial Sequence; identical to SEQ ID NO: 203810
  derived and/or modified sequence opt5 from neuraminidase__InfluenzaA__AEJ37986

SEQ ID NO: 203874 - RNA, 1410 nt, Artificial Sequence; identical to SEQ ID NO: 202434
  derived and/or modified sequence opt5 from neuraminidase__InfluenzaA__AEK21372

SEQ ID NO: 203875 - RNA, 1413 nt, Artificial Sequence; identical to SEQ ID NO: 203228
  derived and/or modified sequence opt5 from neuraminidase__InfluenzaA__AEK21383

SEQ ID NO: 203876 - RNA, 1410 nt, Artificial Sequence; identical to SEQ ID NO: 201664
  derived and/or modified sequence opt5 from neuraminidase__InfluenzaA__AEK21399

SEQ ID NO: 203877 - RNA, 1410 nt, Artificial Sequence; identical to SEQ ID NO: 199762
  derived and/or modified sequence opt5 from neuraminidase__InfluenzaA__AEK21409

SEQ ID NO: 203878 - RNA, 1410 nt, Artificial Sequence; identical to SEQ ID NO: 203733
  derived and/or modified sequence opt5 from neuraminidase__InfluenzaA__AEK21419

SEQ ID NO: 203879 - RNA, 1410 nt, Artificial Sequence; identical to SEQ ID NO: 203810
  derived and/or modified sequence opt5 from neuraminidase__InfluenzaA__AEK21429

SEQ ID NO: 203880 - RNA, 1410 nt, Artificial Sequence
  derived and/or modified sequence opt5 from neuraminidase__InfluenzaA__AEK21439
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaagaaacaagacaucgugggcaucaaugaaugguccggguacucuggcagcuucguccagcaucccgagcuuacaggacuggauuguauucgcccuugcuucuggguggaacucaucagaggccggcccaaggagaacacgauuuggaccuccgggagcucuaucuccuuuuguggaguuaauagcgacacagugggcuggucuuggcccgauggggcugagcugccuuucaccauugacaaauga

SEQ ID NO: 203881 - RNA, 1410 nt, Artificial Sequence; identical to SEQ ID NO: 203810
  derived and/or modified sequence opt5 from neuraminidase__InfluenzaA__AEK21449

SEQ ID NO: 203882 - RNA, 1410 nt, Artificial Sequence; identical to SEQ ID NO: 201664
  derived and/or modified sequence opt5 from neuraminidase__InfluenzaA__AEK21459

SEQ ID NO: 203883 - RNA, 1410 nt, Artificial Sequence; identical to SEQ ID NO: 203810
  derived and/or modified sequence opt5 from neuraminidase__InfluenzaA__AEK21469

SEQ ID NO: 203884 - RNA, 1410 nt, Artificial Sequence; identical to SEQ ID NO: 203810
  derived and/or modified sequence opt5 from neuraminidase__InfluenzaA__AEK21479

SEQ ID NO: 203885 - RNA, 1410 nt, Artificial Sequence; identical to SEQ ID NO: 199762
  derived and/or modified sequence opt5 from neuraminidase__InfluenzaA__AEK21489

SEQ ID NO: 203886 - RNA, 1410 nt, Artificial Sequence; identical to SEQ ID NO: 203478
  derived and/or modified sequence opt5 from neuraminidase__InfluenzaA__AEK28776

SEQ ID NO: 203887 - RNA, 1410 nt, Artificial Sequence
  derived and/or modified sequence opt5 from neuraminidase__InfluenzaA__AEK28787
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccucuagcuccugucaugacggaaaagccuggcugcacgugugcaucacaggcgaugacaagaaugcuaccgccagcuucauuuauaacggccggcuuguugauucuguggucuccuggagcaaagagauccugcgcacccaggaaucugagugugugugcauuaaugggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuacccuagauaccccggcgugcggugugucugccgcgacaacuggaaggggagcaacagaccuaucguggauauuaauaucaaagaccacucuauuguuuccagcuauguguguucuggacuugucggcgacacgccccggaagaacgauagcuccucuagcucccauugccuggacccgaauaacgaggaaggcgggcacggagugaaaggcugggccuucgaugacgggaaugauguuuggaugggacgcaccaucaacgagacaagcagacucggcuacgagaccuuuaaggugaucgaaggguggucuaauccuaaauccaagcugcagauuaaccggcaggucaucguggaccgcggaaauagaagcggcuauucuggcauuuucuccgucgaggggcggagcuguaucaacagaugcuuuuacguggaacugauucgcggacggaaagaggaaaccgagguucucuggacauccaauucuaucguggucuucuguggcaccagcgggacauauggaacgggcuccuggcccgauggggcugaccugaaccuuaugccuauuuga

SEQ ID NO: 203888 - RNA, 1410 nt, Artificial Sequence
  derived and/or modified sequence opt5 from neuraminidase__InfluenzaA__AEK28798
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggaaacgcuuccggcaaggccgauacaaaaauccucuuuaucgaggaagggaagauuguucauaccagcacacuguccggaucugcgcaacacguggaggaaugcagcugcuauccuagauaccccggcgugcggugugucugccgcgacaauuggaagggguccaacagaccuaucguggauauuaauaucaaagaccacagcauuguuucuuccuacguguguagcggacuugucggcgacacgccccggaagaacgauucuagcuccucuagccauugcuccgacccgaauaacgaggaaggcgggcacggagugaaaggcugggccuucgaugacgggaaugauguuuggaugggacgcaccaucagcgagaagucuagacugggcuaugagacauuuaaagugaucgaagggugguccaacccuaagagcaaacuccagauuaaucggcaggucaucguggaccgcggaaacagaucuggcuacuccggcauuuucagcgucgaggggaaguccuguaucaaucggugcuuuuauguggaacugauuagaggacgcaaggaggaaaccgagguucuguggaccucuaacagcaucguggucuucuguggcacauccgggaccuacggaacaggcucuuggcccgauggggcugacauuaaucucaugccuaucuga

SEQ ID NO: 203889 - RNA, 1410 nt, Artificial Sequence
  derived and/or modified sequence opt5 from neuraminidase__InfluenzaA__AEK28809
augaaccccaaucagaagaucauuaccaucggcagcgugucccugacaauuucuacgaucugcuucuuuaugcaaauugccauccucaucaccacagucaccguucacuucaaacaguacgaguuuaacagcccuccgaauaaccaggugaugcugugugaacccacaauuaucgagagaaauauuaccgaaaucguguaucuuacaaacaccacgauugagaaggaaaucugcccuaaacuggcugaguaccggaauugguccaagccccagugugacauuaccggguucgccccuuuuucuaaagauaacagcauccgccucuccgcgggaggcgacaucugggucacaagagagcccuaugugucuugcgauccugacaaguguuaccaauucgcucuggggcagggaaccacacuuaauaacguucauagcaauaacaaggugcgggaucgcaccccguauagaacgcugcucaugaaugaacugggcguccccuuucaccuggggacaaaacaggugugcauugccugguccucuagcuccugucaugacggaaaggccuggcuccacguuugcaucaccggcgaugacaaaaacgcuacagccagcuucauuuacaauggccggcugguggauucugucguguccuggagcaaggagauccuucgcacccaggaaucugagugugugugcauuaacgggaccuguacagucguuaugacggacggauccgcuagcggcaaagccgauaccaagauccuguuuaucgaggaagggaagauugugcauacauccacccucucuggaagcgcgcaacacguggaggaaugcuccugcuauccuagauaccccggcguccggugugugugccgcgacaacuggaaagggagcaauagaccuaucguugauauuaacaucaaggaccacucuauuguguccagcuacgucuguucuggacuggugggcgacacaccccggaaaaaugauagcuccucuagcucccauugccuugacccgaacaaugaggaaggcgggcacggaguuaagggcugggccuucgaugacgggaacgauguguggaugggacgcaccaucagcgagaaaucuagacugggcuaugagacguuuaaggucaucgaagggugguccaauccuaaaagcaagcuccagauuaaccgccaggugaucgucgaccggggaaauagaucuggcuacuccggcauuuucagcguggaggggaaguccuguaucaaccggugcuuuuauguugaacugauuagaggacgcaaagaggaaacagaggugcuguggaccucuaauagcaucgucguguucuguggcaccuccgggacauacggaaccggcucuuggcccgauggggcugacauuaaccucaugccuaucuga

SEQ ID NO: 203890 - RNA, 1410 nt, Artificial Sequence
  derived and/or modified sequence opt5 from neuraminidase__InfluenzaA__AEK28819
augaaccccaaucagaagaucauuaccaucggcagcgugucccugacaauuucuacgaucugcuucuuuaugcaaauugccauccucaucaccacagucacccugcacuucaaacaguacgaguuuaacuauccuccgaauaaccagguuaugcuuugugaacccacaauuaucgagagaaauauuaccgaaaucguguaccugacaaacaccacgauugagaaggaaaucugcccuaaacucgcugaguaucggaauuggagcaagccccagugugacauuaccggguucgccccuuuuuccaaagauaacucuauccgccugagcgcgggaggcgacaucugggugacaagagagcccuacgucuccugcgauccugacaaguguuaucaauucgcucuugggcagggaaccacacugaauaacgugcauucuaauaacaccguucgggaacgcacgccguacagaacacuccugaugaaugagcugggcgugcccuuucaccucgggaccaagcaggucugcauugccuggagcuccagcucuugucaugauggaaaagccuggcugcacgugugcaucacaggcgacgauaagaacgcuaccgccuccuucauuuauaauggccggcuuguugacagcguggucucuugguccaaagaaauccugcgcacccaggagagcgagugugugugcauuaacgggacauguacgguggucaugaccgauggaucugcuuccggcaaggccgacacaaaaauccucuuuaucgaagaggggaagauuguucauaccagcacacuguccggaucugcgcaacacguggaagagugcagcugcuacccuagauaccccggcgugcggugugucugccgcgauaacuggaagggguccaauagaccuaucguggacauuaacaucaaagaucacagcauuguuucuuccuauguguguagcggacuugucggcgacacgccccggaagaaugacucuagcuccucuagccauugccuggauccgaacaaugaagagggcgggcacggagugaaaggcugggccuucgacgaugggaacgacguuuggaugggacgcaccaucuccgaaaagagcagacucggcuacgagacauuuaaagugaucgagggguggucuaauccuaaguccaaacugcagauuaaccggcaggucaucguggaucgcggaaauagaagcggcuauucuggcauuuucuccgucgaaggaaagagcuguaucaaccggugcuuuuacguggagcugauuagagggcgcaaggaagagaccgagguucucuggaccuccaauucuaucguggucuucuguggcacaagcgggaccuauggaacaggcuccuggcccgacggggcugauauuaaccugaugccuaucuga

SEQ ID NO: 203891 - RNA, 1410 nt, Artificial Sequence
  derived and/or modified sequence opt5 from neuraminidase__InfluenzaA__AEK28830
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaucucgcugaguaccggaacugguccaaaccccagugugacauuaccggguucgccccuuuuucuaaggauaauagcauccgccuguccgcgggaggcgacaucugggugacaagagagcccuaugucucuugcgauccugacaaauguuaccaauucgcucuugggcagggaaccacacugaacaaugugcauagcaacaauaccguucggggccgcacgccguauagaacacuccugaugaacgaacugggggugcccuuucaccucggaaccaagcaggucugcauugccugguccucuagcuccugucaugauggcaaggccuggcugcacgugugcaucacaggcgacgauaaaaaugcuaccgccagcuucauuuacaacgggcggcuuguugacucuguggucuccuggagcaaggagauccugcgcacccaggaaucugagugugugugcauuaacggaacauguacgguggucaugaccgauggcuccgcuagcgggaaagccgacacaaagauccucuuuaucgaggaaggaaaaauuguucauaccuccacacugucuggcagcgcgcaacacguggaggaaugcuccugcuauccuagauaccccggggugcggugugucugccgcgauaauuggaagggaagcaacagaccuaucguggacauuaauaucaaggaucacucuauuguuuccagcuacguguguucuggccuugucggcgacacgccccggaaaaacgacagcuccucuagcucccauugccuggauccgaauaacgaggaagggggacacggcgugaaggggugggccuucgacgauggaaaugacguuuggaugggccgcaccaucagcgagaaaucuagacucggguaugagacauuuaaggugaucgaaggaugguccaacccuaaaagcaagcugcagauuaaucggcaggucaucguggaucgcggcaacagaucuggcuacuccgggauuuucagcgucgagggaaaauccuguaucaaucggugcuuuuauguggaacugauuagaggccgcaaggaggaaaccgagguucucuggaccucuaacagcaucguggucuucugugggacauccggaaccuacggcacagggucuuggcccgacggcgcugauauuaaucugaugccuaucuga

SEQ ID NO: 203892 - RNA, 1410 nt, Artificial Sequence
  derived and/or modified sequence opt5 from neuraminidase__InfluenzaA__AEK28841
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacagugaauaacguucauagcaauaacaccgugcggggccgcacgccguauagaacacugcucaugaaugaacuggggguccccuuucaccugggaaccaaacaggugugcauugccugguccucuagcuccugucaugauggcaaggccuggcuccacguuugcaucacaggcgacgauaagaacgcuaccgccagcuucauuuacaaugggcggcugguggacucugucguguccuggagcaaagagauccuucgcacccaggaaucugagugugugugcauuaacggaacauguacggucguuaugaccgauggcuccgcuagcgggaaggccgacacaaaaauccuguuuaucgaggaaggaaagauugugcauaccuccacacucucuggcagcgcgcaacacguggaggaaugcuccugcuauccuagauaccccgggguccggugugugugccgcgauaacuggaagggaagcaauagaccuaucguugacauuaacaucaaagaucacucuauuguguccagcuacgucuguucuggccuggugggcgacacgccccggaagaaugacagcuccucuagcucccauugccuugauccgaacaaugaggaagggggacacggcguuaaagggugggccuucgacgauggaaacgacguguggaugggccgcaccaucagcgagaagucuagacugggguaugagacauuuaaagucaucgaaggaugguccaaucauaagagcaaacuccagauuaaccgccaggugaucgucgaucggggcaauagaucuggcuacuccgggauuuucagcguggagggaaaguccuguaucaaccggugcuuuuauguugaacugauuagaggccgcaaggaggaaaccgaggugcuguggaccucuaauagcaucgucguguucugugggacauccggaaccuacggcacagggucuuggccugacggcgcugaucucaaccugaugcccauuuga

SEQ ID NO: 203893 - RNA, 1410 nt, Artificial Sequence
  derived and/or modified sequence opt5 from neuraminidase__InfluenzaA__AEK28852
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuaagcucgcugaguacagaaauugguccaaaccccagugugacauuaccggguucgccccuuuuucuaaggauaacagcauccggcuguccgcgggaggcgacaucugggugacacgcgagcccuaugucucuugcgauccugacaaguguuaccaauucgcucuugggcagggaaccacacugaauaacgugcauagcaauaacagaguucgggaucgcaccccguauagaacgcuccugaugaaugaacugggcgugcccuuucaccucgggacaaaacaggucugcauugccugguccucuagcuccugucaugacggaaaggccuggcugcacgugugcaucaccggcgaugacaaaaacgcuacagccagcuucauuuacaauggccggcuuguugauucuguggucuccuggagcaaggagauccugcgcacccaggaaucugagugugugugcauuaacgggaccuguacaguggucaugacggacggauccgcuagcggcaaagccgauaccaagauccucuuuaucgaggaagggaagauuguucauacauccacccugucuggaagcgcgcaacacguggaggaaugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccaucagcgagaaaucuagacucggcuaugagacguuuaaggugaucgaagggugguccaauccuaaaagcaagcugcagauuaaccggcaggucaucguggaccgcggaaauagaucuggcuacuccggcauuuucagcgucgaggggaaguccuguaucaaccggugcuuuuauguggaacugauuagaggacgcaaagaggaaacagagguucucuggaccucuaauagcaucguggucuucuguggcaccuccgggacauacggaaccggcucuuggcccgauggggcugacauuaaccugaugccuaucuga

SEQ ID NO: 203894 - RNA, 1410 nt, Artificial Sequence; identical to SEQ ID NO: 201508
  derived and/or modified sequence opt5 from neuraminidase__InfluenzaA__AEK28863

SEQ ID NO: 203895 - RNA, 1410 nt, Artificial Sequence
  derived and/or modified sequence opt5 from neuraminidase__InfluenzaA__AEK28874
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaagguucgggaucgcaccccguauagaacgcuccugaugaaugaacugggcgugcccuuucaccucgggacaaaacaggucugcauugccugguccucuagcuccugucaugacggaaaggccuggcugcacgugugcaucaccggcgaugacaaaaacgcuacagccagcuucauuuacaauggccggcuuguugauucuguggucuccuggagcaaggagauccugcgcacccaggaaucugagugugugugcauuaacgggaccuguacaguggucaugacggacggauccgcuagcggcaaagccgauaccaagauccucuuuaucgaggaagggaagauuguucauacauccacccugucuggaagcgcgcaacacguggaggaaugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccaucagcgagaaaucuagacucggcuaugagacguuuaaggugaucgaagggugguccaaucauaaaagcaagcugcagauuaaccggcaggucaucguggaccgcggaaauagaucuggcuacuccggcauuuucagcgucgaggggaaguccuguaucaaccggugcuuuuauguggaacugauuagaggacgcaaagaggaaacagagguucucuggaccucuaauagcaucguggucuucuguggcaccuccgggacauacggaaccggcucuuggccugauggggcugaccugaaccuuaugcccauuuga

SEQ ID NO: 203896 - RNA, 1410 nt, Artificial Sequence
  derived and/or modified sequence opt5 from neuraminidase__InfluenzaA__AEK28885
augaaccccaaucagaagaucauuaccaucggcagcgugucccugacaauuucuacgaucugcuucuuuaugcaaauugccauccucaucaccacagucacccugcacuucaaacaguacgaguuuaaccuuccuccgaauaaccagguuaugcugugugaacccacaauuaucgagagaaauauuaccgaaaucguguaucucacaaacaccacgauugagaaggaaaucugcccuaaacuggcugaguaccggaauuggagcaagccccagugugacauuaccggguucgccccuuuuuccaaagauaacucuauccgccuuagcgcgggaggcgacaucugggugacaagagagcccuaugucuccugcgauccugacaaguguuaccaauucgcucuggggcagggaaccacacucaauaacgugcauucuaauaacaccguucgggaucgcacgccguauagaacacugcugaugaaugaacucggcgugcccuuucaccuggggaccaagcaggucugcauugccuggagcuccagcucuugucaugacggaaaagccuggcuucacgugugcaucacaggcgaugacaagaacgcuaccgccuccuucauuuacaauggccggcugguugauagcguggucucuugguccaaagagauccuccgcacccaggaaagcgagugugugugcauuaacgggacauguacgguggucaugaccgacggaucugcuuccggcaaggccgauacaaaaauccuguuuaucgaggaagggaagauuguucauaccagcacacuuuccggaucugcgcaacacguggaggaaugcagcugcuauccuagauaccccggcgugcggugugucugccgcgacaacuggaagggguccaauagaccuaucguggauauuaacaucaaagaccacagcauuguuucuuccuacguguguagcggacuggucggcgacacgccccggaagaaugauucuagcuccucuagccauugccucgacccgaacaaugaggaaggcgggcacggagugaaaggcugggccuucgaugacgggaacgauguuuggaugggacgcaccaucuccgaaaagagcagacugggcuaugagacauuuaaagugaucgagggguggucuaauccuaaguccaaacugcagauuaaccggcaggucaucguggaccgcggaaauagaagcggcuacucuggcauuuucuccgucgagggaaagagcuguaucaaccggugcuuuuauguggaacucauuagagggcgcaaggaggaaaccgagguucuguggaccuccaauucuaucguggucuucuguggcacaagcgggaccuacggaacaggcuccuggcccgauggggcugacauuaaccuuaugccuaucuga

SEQ ID NO: 203897 - RNA, 1410 nt, Artificial Sequence; identical to SEQ ID NO: 201633
  derived and/or modified sequence opt5 from neuraminidase__InfluenzaA__AEK28896

SEQ ID NO: 203898 - RNA, 1410 nt, Artificial Sequence
  derived and/or modified sequence opt5 from neuraminidase__InfluenzaA__AEK28907
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuagacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaaccugaugccuaucuga

SEQ ID NO: 203899 - RNA, 1410 nt, Artificial Sequence; identical to SEQ ID NO: 199623
  derived and/or modified sequence opt5 from neuraminidase__InfluenzaA__AEK28918

SEQ ID NO: 203900 - RNA, 1410 nt, Artificial Sequence; identical to SEQ ID NO: 200929
  derived and/or modified sequence opt5 from neuraminidase__InfluenzaA__AEK28929

SEQ ID NO: 203901 - RNA, 1410 nt, Artificial Sequence
  derived and/or modified sequence opt5 from neuraminidase__InfluenzaA__AEK28951
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagauccggcuaugagacauuuaaagugaucgaaggguggagcaaucauaagucuaaacuccagauuaaccggcaggucaucguggaccgcggaaauagauccggcuacagcggcauuuucuccgucgaggggaagucuuguaucaaccggugcuuuuauguggaacugauuagaggacgcaaggaggaaaccgaggcucuguggaccagcaauuccaucguuguguucuguggcacaucugggaccuacggaacaggcagcuggccugauggggccgaccucaaccugaugcccauuuga

SEQ ID NO: 203902 - RNA, 1410 nt, Artificial Sequence
  derived and/or modified sequence opt5 from neuraminidase__InfluenzaA__AEK28962
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguauccuacaaacaccacgauugagaaggaaaucugccccaaacuggcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucagcgagaagucuagacugggcuaugagacauuuaaagugaucgaagggugguccaaucccaagagcaaacuccagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucuguggaccucuaauagcaucguggucuucuguggcacauccgggaccuacggaacaggcucuuggccugauggggcugacauuaaccucaugcccaucuga

SEQ ID NO: 203903 - RNA, 1410 nt, Artificial Sequence
  derived and/or modified sequence opt5 from neuraminidase__InfluenzaA__AEK28973
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaaucauaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggccugauggggcugaccugaacuucaugcccauuuga

SEQ ID NO: 203904 - RNA, 1410 nt, Artificial Sequence
  derived and/or modified sequence opt5 from neuraminidase__InfluenzaA__AEK28984
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcgugcgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagagauucugcgcacccaggaaucugagugugugugcaucaacgggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuauccuagauaccccggcguccggugugugugccgcgacaacuggaaggggagcaauagaccuauuguugauaucaacauuaaagaccacucuaucguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccauuagcgagaagucuagacucggcuaugagacauuuaaagucaucgaagggugguccaauccuaagagcaaacugcagaucaaccgccaggugauugucgaccggggaaauagaucuggcuacuccggcaucuucagcguggaggggaaguccuguauuaaccggugcuuuuauguugaacugaucagaggacgcaaggaggaaaccgaggugcucuggaccucuaauagcauugucguguucuguggcacauccgggaccuacggaacaggcucuuggcccgauggggcugacaucaaccugaugccuauuuga

SEQ ID NO: 203905 - RNA, 1410 nt, Artificial Sequence; identical to SEQ ID NO: 203904
  derived and/or modified sequence opt5 from neuraminidase__InfluenzaA__AEK28995

SEQ ID NO: 203906 - RNA, 1410 nt, Artificial Sequence; identical to SEQ ID NO: 202542
  derived and/or modified sequence opt5 from neuraminidase__InfluenzaA__AEK29006

SEQ ID NO: 203907 - RNA, 1410 nt, Artificial Sequence
  derived and/or modified sequence opt5 from neuraminidase__InfluenzaA__AEK29028
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaugaaagaucacucuaucguuuccagcuacguguguucuggacuugucggcgacacgccccggaagaacgacagcuccucuagcucccauugcuucgauccgaaugacgaggaaggcgggcacggagugaaaggcugggccuuugaugacgggaacgauguuuggaugggacgcaccauuagcgagaagucuagacugggcuaugagacauucaaagugaucgaagggugguccaauccuaagagcaaacuccagaucaaccggcaggucauuguggaccgcggaaauagaucuggcuacuccggcaucuuuagcgucgaggggaaguccuguauuaaccggugcuucuauguggaacugaucagaggacgcaaggaggaaaccgagguucuguggaccucuaauagcauuguggucuucuguggcacauccgggaccuacggaacaggcucuuggcccgauggggcugacaucaaccucaugccuauuuga

SEQ ID NO: 203908 - RNA, 1410 nt, Artificial Sequence
  derived and/or modified sequence opt5 from neuraminidase__InfluenzaA__AEK29050
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucagugugacauuaccggguucgcccccuuuuccaaagauaacucuauccgccugagcgcgggaggcgacaucugggugacaagagagccuuaugucuccugcgauccggacaaguguuaccaauucgcucuugggcagggaaccacacugaauaacgugcauucuaauaacaccguucgggaucgcacgcccuauagaacacuccugaugaaugaacugggcgugccuuuucaccucgggaccaagcaggucugcauugccuggagcuccagcucuugucaugacggaaaagccuggcugcacgugugcaucacaggcgaugacaagaacgcuaccgccuccuucauuuacaauggccggcuuguugauagcguggucucuugguccaaagagauccugcgcacccaggaaagcgagugugugugcauuaacgggacauguacgguggucaugaccgacggaucugcuuccggcaaggccgauacaaaaauccucuuuaucgaggaagggaagauuguucauaccagcacacuguccggaucugcgcaacacguggaggaaugcagcugcuaucccagauacccuggcgugcggugugucugccgcgacaacuggaagggguccaauagacccaucguggauauuaacaucaaagaccacagcauuguuucuuccuacguguguagcggacuugucggcgacaccccgcggaagaaugauucuagcuccucuagccauugccuggacccuaacaaugaggaaggcgggcacggagugaaaggcugggccuucgaugacgggaacgauguuuggaugggacgcacgaucaaugagacauccagacucggcuaugagaccuuuaaggugaucgaaggguggagcaaccccaaaucuaagcugcagauuaaucggcaggucaucguggaccgcggaaacagauccggcuacagcggcauuuucucugucgaggggaaauccuguaucaaucggugcuuuuauguggaacugauuagaggacgcaaggaggaaaccgagguucucuggacaagcaacuccaucguggucuucuguggcaccucugggacauacggaacgggcagcuggccugauggggcugaccugaaucuuaugcccauuuga

SEQ ID NO: 203909 - RNA, 1410 nt, Artificial Sequence
  derived and/or modified sequence opt5 from neuraminidase__InfluenzaA__AEK29061
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagaagaauaucaccgaaauuguguaucugacaaacaccacgaucgagaaagaaauuugcccuaagcucgcugaguacagaaauugguccaaaccccagugugacaucaccggguucgccccuuuuucuaaggauaacagcauccggcuguccgcgggaggcgacauuugggugacacgcgagcccuaugucucuugcgauccugacaaguguuaccaauucgcucuugggcagggaaccacacugaauaacgugcauagcaauaacaucguuagagaucggaccccguaucgcacgcuccugaugaaugaacugggcgugcccuuucaccucgggacaaaacaggucugcauugccugguccucuagcuccugucaugacggaaaggccuggcugcacgugugcaucaccggcgaugacaaaaacgcuacagccagcuucauuuacaauggcagacuuguugauucuguggucuccuggagcaaggagauccugcggacccaggaaucugagugugugugcaucaacgggaccuguacaguggucaugacggacggauccgcuagcggcaaagccgauaccaagauucucuuuaucgaggaagggaagauuguucauacauccacccugucuggaagcgcgcaacacguggaggaaugcuccugcuauccucgcuaccccggcgugagaugugucugccgggacaacuggaaagggagcaaucgcccuaucguggauauuaacaucaaggaccacucuaucguuuccagcuacguguguucuggacuugucggcgacacacccagaaagaaugauagcuccucuagcucccauugccuggacccgaacaaugaggaaggcgggcacggagugaagggcugggccuucgaugacgggaacgauguuuggaugggacggaccauuaaugagacgagccgccucggcuaugagacauuuaaagugaucgaaggguggucuaacccuaaguccaaacugcagauuaauagacaggucaucguggaccggggaaaccgcagcggcuacucuggcauuuucuccgucgaggggaaaagcuguaucaauagaugcuuuuauguggaacugauucggggaagaaaggaggaaaccgagguucucuggaccuccaacucuaucguggucuucuguggcacaagcgggaccuacggaacaggcuccuggcccgauggggcugaccugaaucuuaugccuaucuga

SEQ ID NO: 203910 - RNA, 1410 nt, Artificial Sequence
  derived and/or modified sequence opt5 from neuraminidase__InfluenzaA__AEK29083
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagaagaauaucaccgaaauuguguaucugacaaacaccacgaucgagaaagaaauuugcccuaagcucgcugaguacagaaauugguccaaaccccagugugacaucaccggguucgccccuuuuucuaaggauaacagcauccggcuguccgcgggaggcgacauuugggugacacgcgagcccuaugucucuugcgauccugacaaguguuaccaauucgcucuugggcagggaaccacacugaauaacgugcauagcaauaacaccguuagagaucggacgccguaucgcacacuccugaugaaugaacugggcgugcccuuucaccucgggaccaaacaggucugcaucgccugguccucuagcuccugucaugacggaaaggccuggcugcacgugugcauuacaggcgaugacaaaaacgcuaccgccagcuucaucuacaauggcagacuuguugauucuguggucuccuggagcaaggagauucugcggacccaggaaucugagugugugugcaucaacgggacauguacgguggucaugaccgacggauccgcuagcggcaaagccgauacaaagauccucuuuauugaggaagggaagaucguucauaccuccacacugucuggaagcgcgcaacacguggaggaaugcuccugcuauccucgcuaccccggcgugagaugugucugccgggacaacuggaaagggagcaaucgcccuauuguggauaucaacauuaaggaccacucuaucguuuccagcuacguguguucuggacuugucggcgacacccccagaaagaaugauagcuccucuagcucccauugccuggacccgaacaaugaggaaggcgggcacggagugaagggcugggccuucgaugacgggaacgauguuuggaugggacggacgaucaaugagacaagccgccucggcuaugagaccuuuaaagugauugaaggguggucuaacccuaaguccaaacugcagaucaauagacaggucauuguggaccggggaaaccgcagcggcuacucuggcaucuucuccgucgaggggaaaagcuguauuaauagaugcuuuuauguggaacugauccggggaagaaaggaggaaaccgagguucucuggacauccaacucuauuguggucuucuguggcaccagcgggacauacggaacgggcuccuggcccgauggggcugaccugaaucuuaugccuaucuga

SEQ ID NO: 203911 - RNA, 1410 nt, Artificial Sequence; identical to SEQ ID NO: 202434
  derived and/or modified sequence opt5 from neuraminidase__InfluenzaA__AEK29094

SEQ ID NO: 203912 - RNA, 1410 nt, Artificial Sequence; identical to SEQ ID NO: 202542
  derived and/or modified sequence opt5 from neuraminidase__InfluenzaA__AEK29127

SEQ ID NO: 203913 - RNA, 1410 nt, Artificial Sequence; identical to SEQ ID NO: 202542
  derived and/or modified sequence opt5 from neuraminidase__InfluenzaA__AEK29138

SEQ ID NO: 203914 - RNA, 1410 nt, Artificial Sequence
  derived and/or modified sequence opt5 from neuraminidase__InfluenzaA__AEK29182
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcaggucaaucgccaggugauugucgaccggggaaacagaagcggcuacucuggcaucuucuccguggaggggaaaagcuguauuaaucggugcuuuuauguugaacugaucagaggacgcaaggaggaaaccgaggugcucuggacauccaacucuauugucguguucuguggcaccagcgggacauacggaacgggcuccuggcccgauggggcugaccugaaucuuaugccuaucuga

SEQ ID NO: 203915 - RNA, 1410 nt, Artificial Sequence
  derived and/or modified sequence opt5 from neuraminidase__InfluenzaA__AEK29204
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccaacacaaaaguucucuuuaucgaggaagggaagaucgugcauaccuccacacugucuggaagcgcgcaacacguggaggaaugcuccugcuauccuagauaccccggcguccggugugugugccgcgauaauuggaaggggagcaacagaccuauuguugacaucaauauuaaagaucacucuaucguguccagcuacgucuguucuggacuugugggcgacacgccccggaagaacgacagcuccucuagcucccauugccuggauccgaauaacgaggaaggcgggcacggaguuaaaggcugggccuucgacgaugggaaugacguguggaugggacgcaccauuaacgagacaagcagacucggcuaugagaccuuuaaggucaucgaaggguggucuaauccuaaauccaagcugcagaucaaccgccaggugauugucgaucggggaaauagaagcggcuacucuggcaucuucuccguggaggggaaaagcuguauuaaccggugcuuuuauguugaacugaucagaggacgcaaggaggaaaccgaggugcucuggacauccaauucuauugucguguucuguggcaccagcgggacauacggaacgggcuccuggcccgacggggcugaucugaaccuuaugccuaucuga

SEQ ID NO: 203916 - RNA, 1410 nt, Artificial Sequence
  derived and/or modified sequence opt5 from neuraminidase__InfluenzaA__AEK29215
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucggaaucgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaucaaagaucacucuauuguuuccagcuacguguguucuggacuugucggcgacacgccccggaagaacgacagcuccucuagcucccauugccuggauccgaauaacgaggaaggcgggcacggagugaaaggcugggccuucgacgaugggaaugacguuuggaugggacgcaccaucaacgagacaagcagacucggcuaugagaccuuuaaggugaucgaaggguggucuaauccuaaauccaagcugcagauuaaccggcaggucaucguggaucgcggagacagaagcggcuacucuggcauuuucuccgucgaggggaaaagcuguaucaaucggugcuuuuauguggaacugauuagaggacgcaaggaggaaaccgagguucucuggacauccaacucuaucguggucuucuguggcaccagcgggacauacggaacgggcuccuggcccgauggggcugaccugaaucuuaugccuauuuga

SEQ ID NO: 203917 - RNA, 1410 nt, Artificial Sequence; identical to SEQ ID NO: 203915
  derived and/or modified sequence opt5 from neuraminidase__InfluenzaA__AEK29237

SEQ ID NO: 203918 - RNA, 1410 nt, Artificial Sequence; identical to SEQ ID NO: 202542
  derived and/or modified sequence opt5 from neuraminidase__InfluenzaA__AEK29248

SEQ ID NO: 203919 - RNA, 1410 nt, Artificial Sequence; identical to SEQ ID NO: 202542
  derived and/or modified sequence opt5 from neuraminidase__InfluenzaA__AEK29259

SEQ ID NO: 203920 - RNA, 1410 nt, Artificial Sequence; identical to SEQ ID NO: 202542
  derived and/or modified sequence opt5 from neuraminidase__InfluenzaA__AEK29270

SEQ ID NO: 203921 - RNA, 1413 nt, Artificial Sequence
  derived and/or modified sequence opt5 from neuraminidase__InfluenzaA__AEK59839
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggccugggguggcugaccaucggaauuagcggcccugacaacggggcggucgccgugcucaaauauaacggaaucauuacaggcaccaucaagucuuggaaaaagcagauucugagaacgcaggaauccgagugcguuuguaugaauggcagcugcuuuacaaucaugaccgaugggcccucuaacggagcugccagcuacaaaaucuucaagauugagaagggcaaagugacaaaguccaucgaacuuaaugcuccuaacuuucacuaugaggaauguucuugcuacccggacaccgggauugucaugugugugugccgggauaauuggcacggaagcaaccgccccuggguguccuucaaucagaaccuggacuaccaaaucggcuauauuugcagcggggucuuuggagauaauccuagacccaaagacggcgagggcucuuguaacccuguuaccguggauggggccgacggagugaagggcuucuccuacaaauaugacaauggggucuggaucggacggacaaagagcaaccgccucagaaaaggcuuugagaugauuugggaucccaauggguggacgaacaccgacucugauuucuccgugaagcaggacguuguggcgaucacagauuggagcggcuacuccggaucuuuuguccagcauccggaacugaccggccuugacugcauccggccuuguuucuggguggagcugguucgcgggcuccccagagaaaauacaaccauuuggacgagcggauccucuaucagcuucugcggcgugaacuccgauacagccaacuggagcuggccugacggggcugagcugcccuuuaccauugauaaguga

SEQ ID NO: 203922 - RNA, 1410 nt, Artificial Sequence
  derived and/or modified sequence opt5 from neuraminidase__InfluenzaA__AEK98375
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcgaggccgacacaaagauccucuuuauugaagaggggaaaaucguccauaccuccacacugucuggaagcgcgcaacacguugaagagugcuccugcuauccuagauaccccggcgugcggugugugugccgcgauaacuggaaggggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgagaaaucuagacucggcuaugaaacauuuaagguuauugaggggugguccaacccuaaaagcaagcugcagaccaaucgccaggugaucgucgaucggggaaacagaucuggcuacuccggcauuuucagcguggaagggaaauccuguaucaaucggugcuuuuaugucgagcugauuagaggacgcaaggaagagaccgaggugcucuggacaucuaacagcaucguuguguucuguggcaccuccgggacauacggaacgggcucuuggcccgacggggcugauauuaaucugaugccuaucuga

SEQ ID NO: 203923 - RNA, 1410 nt, Artificial Sequence; identical to SEQ ID NO: 199623
  derived and/or modified sequence opt5 from neuraminidase__InfluenzaA__AEK98377

SEQ ID NO: 203924 - RNA, 1410 nt, Artificial Sequence; identical to SEQ ID NO: 199065
  derived and/or modified sequence opt5 from neuraminidase__InfluenzaA__AEK98379

SEQ ID NO: 203925 - RNA, 1410 nt, Artificial Sequence
  derived and/or modified sequence opt5 from neuraminidase__InfluenzaA__AEK98381
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggagaggccuggcugcacgugugcaucacaggcgacgauaaaaaugcuaccgccagcuucauuuacaacggccggcuuguugacucuaucguguccuggagcaaggaaauucugcgcacccaggagucugagugugucugcaucaaugggacauguacgguggugaugaccgauggauccgcuagcggcgaagccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaagggagcaacagaccuauugucgacaucaauauuaaggaccacucuaucguguccagcuacguuuguucuggacuugugggcgauacgccccggaagaacgacagcuccucuagcucccauugccuggauccgaauaacgaggagggcgggcacggagucaaaggcugggccuucgacgaugggaaugacguguggaugggacgcaccaucagcgaaaagucuagacucggcuaugagacauuuaaaguuauugaagggugguccaacccuaagagcaaacugcagaucaaucgccaggugauugucgaucggggaaacagaucuggcuacuccggcaucuucagcguggaggggaaguccuguauuaaucggugcuuuuaugucgaacugaucagaggacgcaaagaggagaccgaagugcucuggaccucuaacagcauuguuguguucuguggcacauccgggaccuacggaacaggcucuuggcccgacggggcugauaucaaucugaugccuaucuga

SEQ ID NO: 203926 - RNA, 1410 nt, Artificial Sequence; identical to SEQ ID NO: 199065
  derived and/or modified sequence opt5 from neuraminidase__InfluenzaA__AEK98383

SEQ ID NO: 203927 - RNA, 1410 nt, Artificial Sequence; identical to SEQ ID NO: 199623
  derived and/or modified sequence opt5 from neuraminidase__InfluenzaA__AEK98385

SEQ ID NO: 203928 - RNA, 1410 nt, Artificial Sequence
  derived and/or modified sequence opt5 from neuraminidase__InfluenzaA__AEK98387
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuaucgauucuguuguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucaaugagacaagcagacucggcuaugagaccuuuaagguuauugaaggguggucuaacccuaaauccaagcugcagaucaaucgccaggugauugucgaccggggaaacagaagcggcuacucuggcaucuucuccguggaggggaaaagcuguauuaaucggugcuuuuaugucgaacugaucagaggacgcaaggaggaaaccgaggugcucuggacauccaacucuauuguuguguucuguggcaccagcgggacauacggaacgggcuccuggcccgauggggcugaccugaaucuuaugccuaucuga

SEQ ID NO: 203929 - RNA, 1410 nt, Artificial Sequence; identical to SEQ ID NO: 199623
  derived and/or modified sequence opt5 from neuraminidase__InfluenzaA__AEK98389

SEQ ID NO: 203930 - RNA, 1410 nt, Artificial Sequence
  derived and/or modified sequence opt5 from neuraminidase__InfluenzaA__AEK98393
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauugccuccagcuacguuuguucuggacuugugggcgacacgccccggaagaaugauagcuccucuagcucccauugccuggacccgaacaaugaggaaggcgggcacggagucaaaggcugggcuuucgaugacgggaacgauguguggaugggacgcaccaucaaugagacaagcagacucggcuaugagaccuuuaagguuaucgaaggguggucuaacccuaaauccaagcugcagauuaaucgccaggugaucgucgaccggggaaacagaagcggcuacucuggcauuuucuccguggaggggaaaagcuguaucaaucggugcuuuuaugucgaacugauuagaggacgcaaggaggaaaccgaggugcucuggacauccaacucuaucguuguguucuguggcaccagcgggacauacggaacgggcuccuggcccgauggggccgaccugaaucuuaugccuauuuga

SEQ ID NO: 203931 - RNA, 1410 nt, Artificial Sequence; identical to SEQ ID NO: 202542
  derived and/or modified sequence opt5 from neuraminidase__InfluenzaA__AEK98395

SEQ ID NO: 203932 - RNA, 1410 nt, Artificial Sequence
  derived and/or modified sequence opt5 from neuraminidase__InfluenzaA__AEK98397
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaugaaagaucacucuaucguuuccagcuacguguguucuggacuugucggcgacacgccccggaagaacgacagcuccucuagcucccauugccuggauccgaauaacgaggaaggcgggcacggagugaaaggcugggccuucgacgaugggaaugacguuuggaugggacgcaccauuagcgagaagucuagacucggcuaugagacauuuaaagugaucgaagggugguccaacccuaagagcaaacugcagaucaaucggcaggucauuguggaucgcggaaacagaucuggcuacuccggcaucuucagcgucgaggggaaguccuguauuaaucggugcuuuuauguggaacugaucagaggacgcaaggaggaaaccgagguucucuggaccucuaacagcauuguggucuucuguggcacauccgggaccuacggaacaggcucuuggcccgacggggcugauaucaauuucaugccuauuuga

SEQ ID NO: 203933 - RNA, 1410 nt, Artificial Sequence; identical to SEQ ID NO: 199623
  derived and/or modified sequence opt5 from neuraminidase__InfluenzaA__AEK98399

SEQ ID NO: 203934 - RNA, 1410 nt, Artificial Sequence; identical to SEQ ID NO: 199536
  derived and/or modified sequence opt5 from neuraminidase__InfluenzaA__AEK98403

SEQ ID NO: 203935 - RNA, 1410 nt, Artificial Sequence
  derived and/or modified sequence opt5 from neuraminidase__InfluenzaA__AEK98405
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccgggauaauagaucuggauacuccggcaucuucagcguggagggcaaguccuguauuaaccggugcuuuuaugucgaacugaucagagggcgcaaggaggaaaccgaggugcucuggaccucuaauagcauuguuguguucuguggaacauccggcaccuacgggacaggaucuuggcccgacggcgcugauaucaaccugaugccuaucuga

SEQ ID NO: 203936 - RNA, 1410 nt, Artificial Sequence
  derived and/or modified sequence opt5 from neuraminidase__InfluenzaA__AEK98407
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggugcgcacgccguauagaacacuccugaugaaugaacugggcguccccuuucaccucgggaccaaacaggugugcauugccugguccucuagcuccugucaugauggaaaggccuggcugcacguuugcaucacaggcgacgauaagaacgcuaccgccagcuucauuuacaauggccggcuuguggacucuaucgucuccuggagcaaagagauucugcgcacccaggaaucugagugugugugcaucaacgggacauguacgguggucaugaccgauggauccgcuagcggcaaggccgacacaaaaauccucuuuauugaggaagggaagaucguucauaccuccacacugucuggaagcgcgcaacacguggaggaaugcuccugcuauccuagauaccccggcgugcggugugucugccgcgauaacuggaaggggagcaauagaccuauuguggacaucaacauuaaagaucacucuaucguuuccagcuacguguguucuggacuugucggcgacacgccccggaagaaugacagcuccucuagcucccauugccuggauccgaacaaugaggaaggcgggcacggagugaaaggcugggccuucgacgaugggaacgacguuuggaugggacgcaccaucagcgagaagucuagacucggcuaugagacauuuaaagugauugaagggugguccaauccuaagagcaaacugcagaucaaccggcaggucauuguggaucgcgacaauagaucuggauacuccggcaucuucagcgucgagggcaaguccuguauuaaccggugcuuuuauguggaacugaucagagggcgcaaggaggaaaccgagguucucuggaccucuaauagcauuguggucuucuguggaacauccggcaccuacgggacaggaucuuggcccgauggcgcugacaucaaccugaugccuaucuga

SEQ ID NO: 203937 - RNA, 1410 nt, Artificial Sequence; identical to SEQ ID NO: 197351
  derived and/or modified sequence opt5 from neuraminidase__InfluenzaA__AEL11690

SEQ ID NO: 203938 - RNA, 1410 nt, Artificial Sequence; identical to SEQ ID NO: 202037
  derived and/or modified sequence opt5 from neuraminidase__InfluenzaA__AEL89300

SEQ ID NO: 203939 - RNA, 1410 nt, Artificial Sequence; identical to SEQ ID NO: 202037
  derived and/or modified sequence opt5 from neuraminidase__InfluenzaA__AEL89310

SEQ ID NO: 203940 - RNA, 1410 nt, Artificial Sequence; identical to SEQ ID NO: 202037
  derived and/or modified sequence opt5 from neuraminidase__InfluenzaA__AEL89320

SEQ ID NO: 203941 - RNA, 1410 nt, Artificial Sequence; identical to SEQ ID NO: 202037
  derived and/or modified sequence opt5 from neuraminidase__InfluenzaA__AEL89330

SEQ ID NO: 203942 - RNA, 1410 nt, Artificial Sequence; identical to SEQ ID NO: 202037
  derived and/or modified sequence opt5 from neuraminidase__InfluenzaA__AEL89340

SEQ ID NO: 203943 - RNA, 1410 nt, Artificial Sequence; identical to SEQ ID NO: 202037
  derived and/or modified sequence opt5 from neuraminidase__InfluenzaA__AEL89350

SEQ ID NO: 203944 - RNA, 1410 nt, Artificial Sequence; identical to SEQ ID NO: 202037
  derived and/or modified sequence opt5 from neuraminidase__InfluenzaA__AEL89360

SEQ ID NO: 203945 - RNA, 1410 nt, Artificial Sequence; identical to SEQ ID NO: 202037
  derived and/or modified sequence opt5 from neuraminidase__InfluenzaA__AEL89370

SEQ ID NO: 203946 - RNA, 1410 nt, Artificial Sequence; identical to SEQ ID NO: 202037
  derived and/or modified sequence opt5 from neuraminidase__InfluenzaA__AEL89394

SEQ ID NO: 203947 - RNA, 1410 nt, Artificial Sequence; identical to SEQ ID NO: 202037
  derived and/or modified sequence opt5 from neuraminidase__InfluenzaA__AEL89404

SEQ ID NO: 203948 - RNA, 1410 nt, Artificial Sequence; identical to SEQ ID NO: 202037
  derived and/or modified sequence opt5 from neuraminidase__InfluenzaA__AEL89414

SEQ ID NO: 203949 - RNA, 1410 nt, Artificial Sequence; identical to SEQ ID NO: 202037
  derived and/or modified sequence opt5 from neuraminidase__InfluenzaA__AEL89424

SEQ ID NO: 203950 - RNA, 1410 nt, Artificial Sequence; identical to SEQ ID NO: 202037
  derived and/or modified sequence opt5 from neuraminidase__InfluenzaA__AEL89434

SEQ ID NO: 203951 - RNA, 1410 nt, Artificial Sequence; identical to SEQ ID NO: 202037
  derived and/or modified sequence opt5 from neuraminidase__InfluenzaA__AEL89444

SEQ ID NO: 203952 - RNA, 1410 nt, Artificial Sequence; identical to SEQ ID NO: 202037
  derived and/or modified sequence opt5 from neuraminidase__InfluenzaA__AEL89454

SEQ ID NO: 203953 - RNA, 1410 nt, Artificial Sequence; identical to SEQ ID NO: 202037
  derived and/or modified sequence opt5 from neuraminidase__InfluenzaA__AEL89464

SEQ ID NO: 203954 - RNA, 1410 nt, Artificial Sequence; identical to SEQ ID NO: 202037
  derived and/or modified sequence opt5 from neuraminidase__InfluenzaA__AEL89474

SEQ ID NO: 203955 - RNA, 1410 nt, Artificial Sequence
  derived and/or modified sequence opt5 from neuraminidase__InfluenzaA__AEL89484
augaaccccaaucagaagaucauuaccaucggcagcgugugcaugacaauugggauggccaaccugaugcuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaucaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 203956 - RNA, 1410 nt, Artificial Sequence; identical to SEQ ID NO: 203826
  derived and/or modified sequence opt5 from neuraminidase__InfluenzaA__AEL89494

SEQ ID NO: 203957 - RNA, 1410 nt, Artificial Sequence; identical to SEQ ID NO: 203832
  derived and/or modified sequence opt5 from neuraminidase__InfluenzaA__AEL89514

SEQ ID NO: 203958 - RNA, 1410 nt, Artificial Sequence; identical to SEQ ID NO: 203810
  derived and/or modified sequence opt5 from neuraminidase__InfluenzaA__AEL89524

SEQ ID NO: 203959 - RNA, 1410 nt, Artificial Sequence
  derived and/or modified sequence opt5 from neuraminidase__InfluenzaA__AEL89534
augaaccccaaucagaagaucauuaccaucggcagcgugugcaugacaauugggauggccaaccugauccuccaaauuggaaauaucaucuccauuuggaucucucacagcauucagcugggcaaccagaaucagaucgggacguguaaccaauccgucauuaccuacgagaauaacacauggguuaaucagaccuaugugaacaucucuaauacaaacuucgcugccggacagagcguggucuccgugaaacuugcgggcaauucuagccugugcccuguuuccgggugggcuauuuacagcaaggacaacucuaucagaaucggauccaaaggcgauguguuugucauucgggaaccguucaucagcuguucuccccucgagugccgcaccuuuuuccugacacagggcgcccuucugaaugacaagcauuccaacgggaccauuaaagauagaagcccuuaucggacgcucaugucuugucccaucggagaagugccuucccccuacaacagccgcuuugaguccguugccuggucugcuagcgccugccacgacggcauuaauuggcugaccaucgggaucuccggaccugauaacggcgcuguggccguccugaaguauaaugggauuaucacagacaccauuaagagcuggagaaacaauauccuccggacacaagaaucugagugugcgugcgugaacggauccuguuucaccgugaugacggauggcccgagcgacggccaggccucuuacaaaauuuuucgcaucgagaaggggaaaaucgucaagagcguugaaauuaaugcucccaacuaucauuacgaggaaugcuccuguuacccugauucuagcgagaucacaugcgugugcagagacaauuggcacggauccaaccggcccugggugagcuucaaucagaaccuggaguaucagauuggcuacaucuguucugggauuuuuggagauaauccucgccccaacgacaaaaccggcuccugcgggccggucagcucuaauggagccaacggcgugaagggcuucuccuuuaaguaugggaacggaguuuggaucggcagaacaaaaagcauuuccucucggaauggguucgaaaugaucugggauccuaacggauggaccggcaccgacaauaacuuuagcaagaaacaagacaucguggggauuaaugagugguccggcuacucuggcagcuucguccagcaucccgaacuuacaggacuggauuguauccgcccuugcuucuggguggagcucauuagagggcggcccaaggaaaacacgaucuggaccuccggaagcucuauuuccuuuuguggcguuaauagcgacacagugggguggucuuggcccgauggagcugagcugccuuucaccaucgacaaauga

SEQ ID NO: 203960 - RNA, 1410 nt, Artificial Sequence; identical to SEQ ID NO: 203832
  derived and/or modified sequence opt5 from neuraminidase__InfluenzaA__AEL89544

SEQ ID NO: 203961 - RNA, 1410 nt, Artificial Sequence; identical to SEQ ID NO: 203832
  derived and/or modified sequence opt5 from neuraminidase__InfluenzaA__AEL89554

SEQ ID NO: 203962 - RNA, 1410 nt, Artificial Sequence
  derived and/or modified sequence opt5 from neuraminidase__InfluenzaA__AEL89564
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucguuaccuacgaaaauaacacaugggugaaucagaccuaugugaacaucucuaauacaaacuucgcugccgggcagagcgucguguccguuaaacuugcgggaaauucuagccugugcccuguguccggcugggcuauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggccuggucugcuagcgccugccacgacggaauuuccuggcugaccaucggcaucagcgggccugauaauggagcugucgccgugcugaaguauaacggcauuaucacagacaccauuaagucuuggagaaauaacauccuccggacacaagaguccgagugugcgugcgugaaugggagcuguuucaccgucaugacggauggaccgucugacggccaggccagcuacaaaauuuuucgcaucgaaaagggcaaaaucguuaaguccguggagaugaacgcucccaauuaucauuacgaagagugcucuuguuacccugauagcuccgagauuacaugcgugugcagagacaacuggcacgggagcaaucggcccugggucucuuucaaccagaaucuggaauaucagaucggauacauuuguuccggcaucuuuggggauaacccucgccccaaugacaaaaccggaagcugcggcccggugucuuccaacggggccaauggaguuaagggcuucagcuuuaaguauggcaacgggguguggauuggaagaacaaaauccaucucuagccggaacggcuucgagaugauuugggauccuaauggguggaccggaaccgacaacaauuuuuccaucaagcaagacaucgucggcauuaacgaauggucuggguacagcggcuccuucgugcagcaucccgagcuuacaggacuggauuguauccgcccuugcuucuggguugaacucauuagaggccggcccaaagagaauacgaucuggaccagcgggucuuccauuagcuuuuguggagugaacucugacacagucggcugguccuggcccgauggggcugagcugccuuucaccaucgacaaguga

SEQ ID NO: 203963 - RNA, 1410 nt, Artificial Sequence; identical to SEQ ID NO: 203832
  derived and/or modified sequence opt5 from neuraminidase__InfluenzaA__AEL89574

SEQ ID NO: 203964 - RNA, 1410 nt, Artificial Sequence; identical to SEQ ID NO: 203832
  derived and/or modified sequence opt5 from neuraminidase__InfluenzaA__AEL89584

SEQ ID NO: 203965 - RNA, 1410 nt, Artificial Sequence; identical to SEQ ID NO: 200779
  derived and/or modified sequence opt5 from neuraminidase__InfluenzaA__AEL89604

SEQ ID NO: 203966 - RNA, 1410 nt, Artificial Sequence; identical to SEQ ID NO: 203281
  derived and/or modified sequence opt5 from neuraminidase__InfluenzaA__AEL89624

SEQ ID NO: 203967 - RNA, 1410 nt, Artificial Sequence
  derived and/or modified sequence opt5 from neuraminidase__InfluenzaA__AEL89634
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggccaauggagugaagggcuucagcuauaaguacggcaacgggguuuggaucggaagaacaaaauccauuucuagccggaacggcuuugagaugaucugggauccuaauggguggaccggaaccgacaacaauuucuccaucaagcaagacauugugggcaucaacgaauggucuggguauagcggcuccuuuguccagcaucccgagcuuacaggacuggauuguauucgcccuugcuucuggguggaacucaucagaggccggcccaaagagaauacgauuuggaccagcgggucuuccaucagcuucuguggaguuaacucugacacagugggcugguccuggcccgauggggcugagcugccuuuuaccaucgacaaguga

SEQ ID NO: 203968 - RNA, 1410 nt, Artificial Sequence; identical to SEQ ID NO: 202037
  derived and/or modified sequence opt5 from neuraminidase__InfluenzaA__AEL89644

SEQ ID NO: 203969 - RNA, 1410 nt, Artificial Sequence; identical to SEQ ID NO: 203733
  derived and/or modified sequence opt5 from neuraminidase__InfluenzaA__AEL89654

SEQ ID NO: 203970 - RNA, 1410 nt, Artificial Sequence; identical to SEQ ID NO: 203281
  derived and/or modified sequence opt5 from neuraminidase__InfluenzaA__AEL89664

SEQ ID NO: 203971 - RNA, 1410 nt, Artificial Sequence; identical to SEQ ID NO: 203281
  derived and/or modified sequence opt5 from neuraminidase__InfluenzaA__AEL89674

SEQ ID NO: 203972 - RNA, 1410 nt, Artificial Sequence; identical to SEQ ID NO: 203281
  derived and/or modified sequence opt5 from neuraminidase__InfluenzaA__AEL89694

SEQ ID NO: 203973 - RNA, 1410 nt, Artificial Sequence
  derived and/or modified sequence opt5 from neuraminidase__InfluenzaA__AEL89704
augaaccccaaucagaagaucauuaccaucggcagcgugugcaugacaauugggauggccaaccugauccuccaaauuggaaauaucauccugauuuggaucucccacucuauucagcuuggcaaccagaaucagaucgagacguguaaccaaagcgucauuaccuacgaaaauaacacauggguuaaucagaccuaugugaacaucuccaauacaaacuucgcugccgggcagucuguggucagcgugaaacuggcgggaaauuccucucucugcccuguuagcggcugggcuauuuacuccaaggacaacagcaucagaaucgggucuaaaggagauguguuugucauucgggagccguucaucuccuguagcccccuggaaugccgcaccuuuuuccuuacacagggcgcccugcucaaugacaagcauucuaacggcaccauuaaagauagauccccuuaucggacgcugaugagcugucccaucggggaggugccuucucccuacaacucccgcuuugaaagcguugccugguccgcuucugccugccacgacggaauuaauuggcugaccaucggcaucagcgggccugauaacggagcuguggccguccucaaguauaauggcauuaucacagacaccauuaaguccuggagaaacaauauccugcggacacaagagagcgagugugcgugcgugaacgggucuuguuucaccgugaugacggauggaccgaaugacggccaggccuccuacaaaauuuuucgcaucgaaaagggcaaaaucgucaagagcguugagaugaacgcucccaauuaucauuacgaagagugcucuuguuacccugauagcuccgagauuacaugcgugugcagagacaacuggcacgggucuaaucggcccugggugagcuucaaccagaaucuugaauaucagaucggauacauuuguuccggcaucuuuggggauaacccucgccccaaugacaaaaccggaagcugcggcccggucucuuccaacggggccaacggagugaagggcuucagcuuuaaguauggcaaugggguuuggauuggaagaacaaaaucuaucuccagccggaacggcuucgagaugauuugggauccuaauggguggaccggaaccgacaacaauuuuuccgugaagcaagacaucaucggcauuaacgaauggucuggguacagcggcuccuucguccagcaucccgagcugacaggacucgauuguauccgcccuugcuucuggguggaacugauuagaggccggcccaaagagaauacgaucuggaccucugggagcuccauuagcuuuuguggaguuaacucugacacagugggcugguccuggcccgauggggcugagcuuccuuucaccaucgacaaguga

SEQ ID NO: 203974 - RNA, 1410 nt, Artificial Sequence; identical to SEQ ID NO: 203973
  derived and/or modified sequence opt5 from neuraminidase__InfluenzaA__AEL89714

SEQ ID NO: 203975 - RNA, 1410 nt, Artificial Sequence; identical to SEQ ID NO: 203281
  derived and/or modified sequence opt5 from neuraminidase__InfluenzaA__AEL89744

SEQ ID NO: 203976 - RNA, 1410 nt, Artificial Sequence
  derived and/or modified sequence opt5 from neuraminidase__InfluenzaA__AEL89754
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuucuagccggaacggcuucgagaugaucugggauccuaauggguggaccggaaccgacaacaauuuuuccaucaagcaagacauugugggcaucaacgaauggucuggguacagcggcuccuucguccagcaucccgagcuuacaggacuggauuguauucgcccuugcuucuggguggaacucaucagaggccggcccaaagagaauacgauuuggaccagcgggucuuccaucagcuuuuguggaguuaacucugacacagugggcugguccuggcccgauggggcugagcugccuuucaucauugacaaguga

SEQ ID NO: 203977 - RNA, 1410 nt, Artificial Sequence; identical to SEQ ID NO: 202037
  derived and/or modified sequence opt5 from neuraminidase__InfluenzaA__AEL89774

SEQ ID NO: 203978 - RNA, 1410 nt, Artificial Sequence
  derived and/or modified sequence opt5 from neuraminidase__InfluenzaA__AEL89784
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucucccuucggaauggcuucgagaugauuugggauccuaacggguggaccggaaccgacaauaacuuuucugugaagcaagacaucaucggcauuaaugaauggagcggguacuccggcucuuucguccagcaucccgagcugacaggacucgauuguauccgcccuugcuucuggguggaacugauuagaggccggcccaaagagaacacgaucuggaccagcggguccagcauuucuuuuuguggaguuaauuccgacacagugggcuggagcuggcccgauggggcugagcuuccuuucaccaucgacaaguga

SEQ ID NO: 203979 - RNA, 1410 nt, Artificial Sequence
  derived and/or modified sequence opt5 from neuraminidase__InfluenzaA__AEL89794
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggaguuaauucugacgcugugggcugguccuggcccgauggggccgagcugccuuucacaaucgacaaauga

SEQ ID NO: 203980 - RNA, 1410 nt, Artificial Sequence; identical to SEQ ID NO: 203733
  derived and/or modified sequence opt5 from neuraminidase__InfluenzaA__AEL89804

SEQ ID NO: 203981 - RNA, 1410 nt, Artificial Sequence
  derived and/or modified sequence opt5 from neuraminidase__InfluenzaA__AEL89815
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcgugaagcaagacaucaucggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 203982 - RNA, 1410 nt, Artificial Sequence
  derived and/or modified sequence opt5 from neuraminidase__InfluenzaA__AEL89825
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggggccaaccggcccuggguguccuucaaucagaaccuggaauaucagaucggauacauuuguagcggcaucuuuggggauaauccucgccccaacgacaaaaccggaucuugcggcccggucuccagcaauggggcuaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcuuacaggacuggauuguauccgcccuugcuucuggguggaacucauuagaggccggcccaaagagaacacgaucuggaccagcggguccagcauuucuuuuuguggaguuaauuccgacacagugggcuggagcuggcccgauggggccgagcugccuuucaccaucgacaaguga

SEQ ID NO: 203983 - RNA, 1410 nt, Artificial Sequence
  derived and/or modified sequence opt5 from neuraminidase__InfluenzaA__AEL89835
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugugugcgugaaugggagcuguuucaccauuaugacggauggaccgucugacggccaggcgagcuacaaaaucuuucgcaucgaaaagggcaaaauugucaaguccguugagaugaacgcccccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggcuaauggagugaagggcuucagcuuuaaguauggcaacgggguuuggaucggaagaacaaaauccauuucuagccggaagggcuucgagaugaucugggauccuaacggguggaccggaaccgacaauaacuuuuccaucaaacaagacauugugggcaucaaugaauggucuggguacagcggcuccuucguccagcaucccgagcuuacaggacuggauuguauucgcccuugcuucuggguggaacucaucagaggccggcccaaggagaacacgauuuggaccagcgggucuuccaucagcuuuuguggaguuaauucugacacagugggcugguccuggcccgauggggccgagcugccuuucaccaucgacaaauga

SEQ ID NO: 203984 - RNA, 1410 nt, Artificial Sequence
  derived and/or modified sequence opt5 from neuraminidase__InfluenzaA__AEL89845
augaaccccaaucagaagaucauuaccaucggcagcgugugcaugacaauugggauggccaaccugauccuccaaauuggaaauaucaucuccauuuggaucucucacagcauucagcugggcaacaaaaaucagaucgagacguguaaccaguccgucauuaccuacgaaaauaacacauggguuaaucaaaccuaugugaacaucucuaauacaaacuucgcuaccgggcagagcguggucuccgugaaacuugccggaaauucuagccugugcccuguuuccggcugggcgauuuacagcaaggacaacucuaucagaaucggguccaagggagauguguuugucauucgggagccguucaucagcuguucuccccucgaaugccgcacauuuuuccugacccagggcgcccuucugaaugacaaacauuccaacggcacgauuaaggauagaagcccuuaucggacccucaugucuugucccaucggggaggcuccuucccccuacaacagccgcuuugaauccguggccuggucugcuagcgccugccacgacggaauuaauuggcugacaaucggcaucuccgggccugauaacggagcuguugccgugcugaaguauaauggcauuaucaccgacacaauuaaaagcuggagaaacaauauccuccggacccaggagucugagugugcgugcgucaacggguccuguuucacggugaugacagauggaccgagcgacggccaagccucuuacaagauuuuucgcaucgaaaaaggcaagaucgugaaaagcgucgagaugaaugcucccaacuaucauuacgaagagugcuccuguuacccugauucuagcgagauuaccugcguuugcagagacaauuggcacggguccaaccggcccugggugagcuucaaucagaaccuggaauaucagaucggauacauuuguucuggcaucuuuggggauaauccucgccccaacgacaagaagggauccugcggcccggugagcucuaauggggccaacggagucaaaggcuucuccuuuaaguauggcaacgggguguggauuggaagaacaaaaagcaucuccucucggaauggcuucgagaugauuugggauccuaacggguggaccggaaccgacaauaacuuuagcaucaagcaggacaucguuggcauuaaugaaugguccggguacucuggcagcuucgugcaacaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggcugagcugccuuucaccaucgacaaguga

SEQ ID NO: 203985 - RNA, 1410 nt, Artificial Sequence; identical to SEQ ID NO: 203982
  derived and/or modified sequence opt5 from neuraminidase__InfluenzaA__AEL89855

SEQ ID NO: 203986 - RNA, 1410 nt, Artificial Sequence; identical to SEQ ID NO: 203281
  derived and/or modified sequence opt5 from neuraminidase__InfluenzaA__AEL93581

SEQ ID NO: 203987 - RNA, 1410 nt, Artificial Sequence
  derived and/or modified sequence opt5 from neuraminidase__InfluenzaA__AEL93591
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaucuugcgggaaacucuagccugugcccuguuuccggcugggcuauuuacagcaaagacaauucuaucagaaucggguccaagggagauguguuugucauucgggagccguucaucagcuguucuccccucgaaugccgcaccuuuuuccugacacagggcgcccuucugaacgacaaacauuccaacggcaccauuaaggauagaagcccuuaucggacgcucaugucuugucccaucggggaggugccuucccccuacaauagccgcuuugaauccguugccuggucugcuagcgccugccacgacggaauuaacuggcugaccaucggcaucuccgggccugauaauggagcuguggccguccugaaauauaacggcauuaucacagacaccauuaagagcuggagaaauaacauccuccggacacaagagucugagugugcgugcgugaauggguccuguuucaccauuaugacggauggaccgagcgacggccaggccucuuacaagaucuuucgcaucgaaaaaggcaagauugugaaaagcgucgagaugaacgcucccaauuaucauuacgaagagugcuccuguuacccugauucuagcgagaucacaugcguuugcagagacaacuggcacggguccaaucggcccugggugagcuucaaccagaaucuggaauaucagauuggauacaucuguucuggcauuuuuggggauaacccucgccccaaugacaagaccggauccugcggcccggugagcucuaacggggccaacggagucaaaggcuucuccuuuaaguauggcaaugggguguggaucggaagaacaaagagcauuuccucucggaaaggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 203988 - RNA, 1410 nt, Artificial Sequence; identical to SEQ ID NO: 203733
  derived and/or modified sequence opt5 from neuraminidase__InfluenzaA__AEL93601

SEQ ID NO: 203989 - RNA, 1410 nt, Artificial Sequence; identical to SEQ ID NO: 203281
  derived and/or modified sequence opt5 from neuraminidase__InfluenzaA__AEL93611

SEQ ID NO: 203990 - RNA, 1410 nt, Artificial Sequence; identical to SEQ ID NO: 203281
  derived and/or modified sequence opt5 from neuraminidase__InfluenzaA__AEL93621

SEQ ID NO: 203991 - RNA, 1410 nt, Artificial Sequence; identical to SEQ ID NO: 203281
  derived and/or modified sequence opt5 from neuraminidase__InfluenzaA__AEL93631

SEQ ID NO: 203992 - RNA, 1410 nt, Artificial Sequence
  derived and/or modified sequence opt5 from neuraminidase__InfluenzaA__AEL93641
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccauaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuucuagccggaacggcuucgagaugaucugggauccuaauggguggaccggaaccgacaacaauuuuuccaucaagcaggacauugugggcaucaacgaauggucuggguacagcggcuccuucguccaacaccccgagcuuacaggacuggauuguauucgcccuugcuucuggguggaacucaucagaggccagcccaaagagaauacgauuuggaccagcgggucuuccaucagcuuuuguggaguuaacucugacacagugggcugguccuggcccgauggggcugagcugccuuucaccaucgacaaguga

SEQ ID NO: 203993 - RNA, 1410 nt, Artificial Sequence; identical to SEQ ID NO: 203832
  derived and/or modified sequence opt5 from neuraminidase__InfluenzaA__AEL94890

SEQ ID NO: 203994 - RNA, 1410 nt, Artificial Sequence
  derived and/or modified sequence opt5 from neuraminidase__InfluenzaA__AEL95429
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccucaccggacgcucauguccugucccaucggggaggugccuagccccuauaacucccgcuuugaaucuguugccuggagcgcuuccgccugccaugacggaauuaacuggcugaccaucggcaucagcgggccugauaauggagcuguggccguccugaaguacaacggcauuaucacagacaccauuaagucuuggagaaauaacauccuccggacacaagaguccgagugugcgugcgugaaugggagcuguuucaccauuaugacggauggaccgucugacggccaggccagcuauaaaaucuuucgcaucgaaaagggcaaaauugugaaguccgucgagaugaacgcucccaauuaccacuaugaagagugcucuuguuacccugauagcuccgagaucacaugcguuugcagagacaacuggcaugggagcaaucggcccugggugucuuucaaccagaaucuggaauaccagauuggauauaucuguuccggcauuuuuggggauaacccucgccccaaugacaaaaccggaagcugcggcccggugucuuccaacggggccaauggagucaagggcuucagcuuuaaguacggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguauagcggcuccuucgugcagcaccccgagcuuacaggacuggauuguauucgcccuugcuucugggucgaacucaucagaggccggcccaaggagaacacgauuuggaccagcgggucuuccaucagcuuuuguggaguuaauucugacacagugggcugguccuggcccgauggggcugagcugccuuucaccaucgacaaauga

SEQ ID NO: 203995 - RNA, 1410 nt, Artificial Sequence
  derived and/or modified sequence opt5 from neuraminidase__InfluenzaA__AEL97634
augaaccccaaucagaagaucauuaccaucggcagcgugugcaugacaauugggauggccaaccugauccuccaaauuggaaauaucaucuccauuugggucucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcgugaaugaaugguccggguacucuggcagcuucguucagcaucccgagcuuacaggacuggauuguauccgcccuugcuucuggguggaacucauuagaggccggcccaaagagaacacgaucuggaccuccgggagcucuauuuccuuuuguggagucaauagcgacacagugggcuggucuuggcccgauggggcugagcugccuuucaccaucgacaaguga

SEQ ID NO: 203996 - RNA, 1410 nt, Artificial Sequence; identical to SEQ ID NO: 199762
  derived and/or modified sequence opt5 from neuraminidase__InfluenzaA__AEL99667

SEQ ID NO: 203997 - RNA, 1410 nt, Artificial Sequence; identical to SEQ ID NO: 199762
  derived and/or modified sequence opt5 from neuraminidase__InfluenzaA__AEL99677

SEQ ID NO: 203998 - RNA, 1410 nt, Artificial Sequence; identical to SEQ ID NO: 198800
  derived and/or modified sequence opt5 from neuraminidase__InfluenzaA__AEM53471

SEQ ID NO: 203999 - RNA, 1413 nt, Artificial Sequence; identical to SEQ ID NO: 199477
  derived and/or modified sequence opt5 from neuraminidase__InfluenzaA__AEM60040

SEQ ID NO: 204000 - RNA, 1413 nt, Artificial Sequence; identical to SEQ ID NO: 199067
  derived and/or modified sequence opt5 from neuraminidase__InfluenzaA__AEM60061

SEQ ID NO: 204001 - RNA, 1410 nt, Artificial Sequence
  derived and/or modified sequence opt5 from neuraminidase__InfluenzaA__AEM60072
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacgagaacgcuaccgccagcuucauuuacgaugggcggcuugucgacucuaucggauccuggagcaaaaauauucugcgcacccaggaaucugagugcguguguaucaacggcacaugcacgguggucaugaccgauggguccgcuagcgagagagccgacacaaagauucucuuuaucgaagagggaaaaaucguucacauuagcccccugucuggcagcgcgcaacauguggaagagugcuccuguuauccucgguaccccggggugcgcugcgucuguagagauaauuggaagggaagcaaccggccgaucguggacauuaacguuaaggauuacucuaucguguccagcuaugucugcucuggccuugugggcgacaccccucgcaaaaaugacagaagcuccucuagcuacugucggaaccccaauaacgaaaaggggucccacggaguuaaaggcugggccuucgaugacgggaaugauguguggaugggacgcacaauuggcgaggagcugagaagcggguaugaaaccuuuaaggucaucggaggcuggucuacgccuaacuccaaacuccagaucaauagacaggugauugucgacagcggcaaccggucuggguacuccggaaucuucagcguggagggcaaguccugcauuaaucgcuguuuuuauguugaacugauccgggggagagagcaggaaacacgcgugugguggaccucuaacagcauugucguguucugcggaaccuccggcacauacgggaccggcucuuggcccgauggagcugacaucaaucugaugcccauuuga

SEQ ID NO: 204002 - RNA, 1410 nt, Artificial Sequence; identical to SEQ ID NO: 199762
  derived and/or modified sequence opt5 from neuraminidase__InfluenzaA__AEM62774

SEQ ID NO: 204003 - RNA, 1410 nt, Artificial Sequence; identical to SEQ ID NO: 199762
  derived and/or modified sequence opt5 from neuraminidase__InfluenzaA__AEM62783

SEQ ID NO: 204004 - RNA, 1410 nt, Artificial Sequence
  derived and/or modified sequence opt5 from neuraminidase__InfluenzaA__AEM62792
augaaccccaaucagaagaucauuaccaucggcagcgugugcaugacaauugggauggccaaccugauccuccaaauuggaaauaucaucuccauuuggaucucucacagcauucagcugggcucccagaaccagaucgagacguguaaucaaucugucauuaccuacgaaaacaauacauggguuaaccagaccuaugugaauaucagcaacacaaauuucgcugccgggcaguccgugauuucugucagacuugcgggaaacagcucccugugcccugugagcggcugggcuaucuacucuaaagacaauuccauccggauugggagcaagggagauguuuuugugauccgcgagccguucauuucuuguagcccccucgaaugcagaaccuuuuuccugacacagggcgcccuucugaacgacaaacauuccaauggcaccaucaaggaucggucuccuuaucgcacgcucauguccugucccauuggggaggucccuagccccuacaacuccagauuugaaucuguggccuggagcgcuuccgccugccacgacggaaucaacuggcugaccaucggcauuagcgggccugauaauggagcuguugccgugcugaaauauaacggcaucauuacagacaccaucaagucuuggcggaauaacauucuccgcacacaagaguccgagugugcgugcgucaaugggagcuguuucaccgugaugacggauggaccgucugacggccaggccagcuacaagaucuuuagaaucgaaaaaggcaagauugugaaauccgucgagaugaacgcucccaauuaucauuacgaagagugcucuuguuacccugauagcuccgagaucacaugcguuugccgggacaacuggcacgggagcaaucgccccugggugucuuucaaccagaaucuggaauaucagauuggauacaucuguuccggcauuuuuggggauaacccuagacccaaugacaagaccggaagcugcggcccggugucuuccaacggggccaauggagucaaaggcuucagcuuuaaguauggcaacgggguguggaucggacggacaaaguccauuucuagccgcaacggcuucgagaugaucugggauccuaauggguggaccggaaccgacaacaauuuuuccaucaaacaagacauuaucggcauuaacgaauggucuggguacagcggcuccuucguucagcaucccgagcuuacaggacuggauuguaucagaccuugcuucuggguggaacucauucggggccgccccaaggagaauacgaucuggaccagcgggucuuccaucagcuuuuguggagucaacucugacacagugggcugguccuggcccgauggggcugagcugccuuucaccauugacaaauga

SEQ ID NO: 204005 - RNA, 1410 nt, Artificial Sequence; identical to SEQ ID NO: 199762
  derived and/or modified sequence opt5 from neuraminidase__InfluenzaA__AEM62801

SEQ ID NO: 204006 - RNA, 1410 nt, Artificial Sequence
  derived and/or modified sequence opt5 from neuraminidase__InfluenzaA__AEM62810
augaaccccaaucagaagaucauuaccaucggcagcgugugcaugacaauugggaugggaaaccugauccuccaaauuggcaauaucaucuccauuuggaucucucacagcauucagcuggggaaccagaaucagaucgagacguguaaccaauccgucauuaccuacgaaaauaacacauggguuaaucagaccuaugugaacaucucuaauacaaacuucgccgcuggacagagcguggucuccgugaaacuugccggcaauucuagccugugcccuguuuccgggugggcgauuuacagcaaggacaacucuaucagaaucggauccaaaggcgauguguuugucauucgggagccguucaucagcuguucuccccucgaaugccgcaccuuuuuccugacacagggcgcccuucugaaugacaagcauuccaacgggaccauuaaagauagaagcccuuaucggacgcucaugucuugucccaucggagaggugccuucccccuacaacagccgcuuugaauccguugcuuggucugccagcgcuugccacgacggcauuaauuggcugaccaucgggaucuccggaccugauaacggcgccguggcuguccugaaguauaaugggauuaucacagacaccauuaagagcuggagaaacaauauccuccggacacaagagucugagugugccugcgugaacggauccuguuucaccgugaugacggauggcccgagcgacggccaggcgucuuacaaaauuuuucgcaucgaaaaggggaaaaucgucaagagcguugagaugaaugcccccaacuaucauuacgaagagugcuccuguuacccugauucuagcgagauuacaugcgugugcagagacaauuggcacggauccaaccggcccugggugagcuucaaucagaaccuggaauaucagaucggcuacauuuguucugggaucuuuggagauaauccucgccccaacgacaaaaccggcuccugcgggccggucagcucuaauggagcuaacggcgugaagggcuucuccuuuaaguaugggaacggaguuuggauuggcagaacaaaaagcaucuccucucggaauggguucgagaugauuugggauccuaacggauggaccggcaccgacaauaacuuuagcaucaagcaagacaucguggggauuaaugaaugguccggcuacucuggcagcuucguccagcaucccgagcuuacaggacuggauuguauccgcccuugcuucuggguggaacucauuagagggcggcccaaagagaacacgaucuggaccuccggaagcucuauuuccuuuuguggcguuaauagcgacacagugggguggucuuggcccgauggagccgagcugccuuucaccaucgacaaguga

SEQ ID NO: 204007 - RNA, 1410 nt, Artificial Sequence
  derived and/or modified sequence opt5 from neuraminidase__InfluenzaA__AEM62819
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaaugacacauggguuaaccagaccuaugugaauaucucuaacacaaauuucgcugccgggcagagcguggucuccgugaaacuugcgggaaacucuagccugugcccuguuuccggcugggcuauuuacagcaaggauaauucuaucagaaucggguccaaaggagacguguuugucauucgggagccguucaucagcuguucuccccucgaaugccgcaccuuuuuccugacacagggcgcccuucugaacgauaagcauuccaauggcaccauuaaagacagaagcccuuaucggacgcucaugucuugucccaucggggaggugccuucccccuacaacagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccgugaugacggacggaccgagcgauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaauggagugaagggcuucuccuuuaaguauggcaacgggguuuggauuggaagaacaaaaagcaucuccucucggaacggcuucgagaugauuugggacccuaauggguggaccggaaccgacaacaauuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 204008 - RNA, 1410 nt, Artificial Sequence; identical to SEQ ID NO: 199762
  derived and/or modified sequence opt5 from neuraminidase__InfluenzaA__AEM62828

SEQ ID NO: 204009 - RNA, 1410 nt, Artificial Sequence; identical to SEQ ID NO: 200345
  derived and/or modified sequence opt5 from neuraminidase__InfluenzaA__AEM62837

SEQ ID NO: 204010 - RNA, 1410 nt, Artificial Sequence; identical to SEQ ID NO: 199762
  derived and/or modified sequence opt5 from neuraminidase__InfluenzaA__AEM62846

SEQ ID NO: 204011 - RNA, 1410 nt, Artificial Sequence
  derived and/or modified sequence opt5 from neuraminidase__InfluenzaA__AEM62855
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucugugagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggccuggucugcuagcgccugccacgacggaauuaauuggcugaccaucggcaucuccgggccugauaacggagcugucgccgugcugaaguauaauggcauuaucacagacaccauuaagagcuggagaaacaauauccuccggacacaagagucugagugugcgugcgugaacggguccuguuucaccgucaugacggauggaccgagcaauggccaggccucuuacaaaauuuuucgcaucgaaaagggcaaaaucguuaagagcguggagaugaacgcucccaauuaucauuacgaagagugcuccuguuacccugacucuggggagauuacaugcgugugcagagauaacuggcacggaagcaaucggcccugggucuccuucaaccagaaucuggaauaucagaucggcuacauuuguagcgggaucuuuggagacaacccucgccccaaugauaaaaccggcucuugcgggccgguguccagcaacggagccaacggcguuaagggcuucucuuuuaaguaugggaauggaguguggauuggcagaacaaaauccaucagcucccggaacggguucgagaugauuugggacccuaauggauggaccggcaccgauaacaauuuuucuaucaagcaagacaucgucgggauuaacgaauggagcggcuacuccggaucuuucgugcagcaucccgagcuuacaggccuggacuguauccgcccuugcuucuggguugaacucauuagagggcggcccaaagagaauacgaucuggaccagcggauccagcauuucuuuuuguggcgugaacuccgauacagucggguggagcuggcccgacggagcugagcugccuuucaccaucgauaaguga

SEQ ID NO: 204012 - RNA, 1410 nt, Artificial Sequence
  derived and/or modified sequence opt5 from neuraminidase__InfluenzaA__AEM62864
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuucgggccugauaacggagcuguggccguccugaaguauaauggcauuaucacagacaccauuaaguccuggagaaacaauauccuccggacacaagagagcgagugugcgugcgugaacgggucuuguuuuaccgugaugacggauggaccguccgacggccaggccagcuacaaaauuuuccgcaucgaaaagggcaaaaucgucaagucuguugagaugaaugcucccaacuaucauuacgaagagugcagcuguuacccugauuccucugagauuacaugcgugugcagagacaauuggcacgggagcaaccggcccuggguguccuuuaaucagaaccuggaauaucagaucggauacauuuguagcggcaucuucggggauaauccucgccccaacgacaaaaccggaucuugcggcccggucuccagcaauggggccaacggagugaagggcuuuucuuucaaguauggcaacgggguuuggauuggaagaacaaaauccaucagcucccggaauggcuuugagaugauuugggauccuaacggguggaccggaaccgacaauaacuucucuaucaagcaagacaucgugggcauuaaugaauggagcggguacuccggcucuuucguccagcaucccgagcuuacaggacuggauuguauccgcccuugcuuuuggguggaacucauuagaggccggcccaaagagaacacgaucuggaccagcggguccagcauuucuuucuguggaguuaauuccgacacagugggcuggagcuggcccgauggggcugagcugccuuuuaccaucgacaaguga

SEQ ID NO: 204013 - RNA, 1410 nt, Artificial Sequence
  derived and/or modified sequence opt5 from neuraminidase__InfluenzaA__AEM62872
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcuucaauggggccaacggagugaagggcuuuucuuucaaguauggcaacgggguuuggauuggaagaacaaaauccaucagcucccggaauggcuuugagaugauuugggauccuaacggguggaccggaaccgacaauaacuucucuaucaagcaagacaucgugggcauuaaugaauggagcggguacuccggcucuuucguccagcaucccgagcuuacaggacuggauuguauccgcccuugcuuuuggguggaacucauuagaggccggcccaaagagaacacgaucuggaccagcggguccagcauuucuuucuguggaguuaauuccgacacagugggcuggagcuggcccgauggggcugagcugccuuuuaccaucgacaaguga

SEQ ID NO: 204014 - RNA, 1410 nt, Artificial Sequence; identical to SEQ ID NO: 199762
  derived and/or modified sequence opt5 from neuraminidase__InfluenzaA__AEM92310

SEQ ID NO: 204015 - RNA, 1410 nt, Artificial Sequence; identical to SEQ ID NO: 201224
  derived and/or modified sequence opt5 from neuraminidase__InfluenzaA__AEM92320

SEQ ID NO: 204016 - RNA, 1410 nt, Artificial Sequence
  derived and/or modified sequence opt5 from neuraminidase__InfluenzaA__AEM92340
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggacccgcaccgacaacaauuuuagcaucaaacaagacauuguuggaaucaacgaaugguccggcuacucugggagcuucgugcagcaucccgagcuuacaggccuggauuguauuagaccuugcuucugggucgaacucauccggggacgccccaaggagaauacgauuuggaccuccggcagcucuaucuccuuuuguggggugaacagcgacacaguuggauggucuuggcccgauggcgcugagcugccuuucaccaucgacaaauga

SEQ ID NO: 204017 - RNA, 1410 nt, Artificial Sequence; identical to SEQ ID NO: 201224
  derived and/or modified sequence opt5 from neuraminidase__InfluenzaA__AEM92350

SEQ ID NO: 204018 - RNA, 1410 nt, Artificial Sequence
  derived and/or modified sequence opt5 from neuraminidase__InfluenzaA__AEM92360
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgagcagagcguggucuccgugaaacuugcggggaauagcagccugugcccuguuuccggaugggcuauuuacagcaaggacaacucuaucagaaucggcuccaaaggggauguguuugucauucgggaaccguucaucagcuguucuccccucgagugccgcaccuuuuuccugacacagggagcccuucugaaugacaagcauuccaacggcaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcgugaacggcuccuguuucaccauuaugacggaugggccgagcgacggacaggccucuuacaaaaucuuucgcaucgagaagggcaaaauugugaagucugucgaaaugaaugcucccaacuaucauuacgaggagugcuccuguuacccugauucuagcgaaaucacaugcguuugcagagacaauuggcacggcuccaaccggcccugggugagcuucaaucagaaccuggaguaucagauuggguacaucuguucuggaauuuuuggcgauaauccucgccccaacgacaaaaccggguccugcggaccggugagcucuaauggcgccaacggggucaagggauucuccuuuaaguauggcaacggcguguggaucgggagaacaaaaagcauuuccucucggaagggauucgaaaugaucugggauccuaauggcuggaccgggaccgacaacaauuuuagcaucaaacaagacauuguuggaaucaacgagugguccggcuacucugggagcuucgugcagcaucccgaacuuacaggccuggauuguauucgcccuugcuucugggucgagcucaucagaggacggcccaaggagaauacgauuuggaccuccggcagcucuaucuccuuuuguggggugaacagcgacacaguuggauggucuuggcccgauggcgcugaacugccuuucaccaucgacaaauga

SEQ ID NO: 204019 - RNA, 1410 nt, Artificial Sequence; identical to SEQ ID NO: 204016
  derived and/or modified sequence opt5 from neuraminidase__InfluenzaA__AEM92370

SEQ ID NO: 204020 - RNA, 1410 nt, Artificial Sequence; identical to SEQ ID NO: 204016
  derived and/or modified sequence opt5 from neuraminidase__InfluenzaA__AEM92380

SEQ ID NO: 204021 - RNA, 1410 nt, Artificial Sequence
  derived and/or modified sequence opt5 from neuraminidase__InfluenzaA__AEM92399
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaaccaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccgguccuuagcaauggggccaacggagugaagggcuucucuuuuaaguauggcaacgggguuuggaucggaagaaccaaauccauuagcucccggaauggcuucgagaugaucugggauccuaacggguggaccggaacagacaauaacuuuucuauuaagcaagacaucgugggcaucaaugaauggagcggguacuccggcucuuucguccagcaucccgagcugacgggacucgauuguauucgcccuugcuucuggguggaacugaucagaggccggcccaaagagaacaccauuuggacaagcggguccagcaucucuuuuuguggaguuaauuccgacaccgugggcuggagcuggcccgauggggcugagcuuccuuucacaauugacaaguga

SEQ ID NO: 204022 - RNA, 1410 nt, Artificial Sequence; identical to SEQ ID NO: 204021
  derived and/or modified sequence opt5 from neuraminidase__InfluenzaA__AEM92409

SEQ ID NO: 204023 - RNA, 1410 nt, Artificial Sequence; identical to SEQ ID NO: 200186
  derived and/or modified sequence opt5 from neuraminidase__InfluenzaA__AEM92419

SEQ ID NO: 204024 - RNA, 1410 nt, Artificial Sequence
  derived and/or modified sequence opt5 from neuraminidase__InfluenzaA__AEM92430
augaaccccaaucagaagaucaugaccauuggcagcgugugcaugacaaucgggauggccaaccugauucuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 204025 - RNA, 1410 nt, Artificial Sequence
  derived and/or modified sequence opt5 from neuraminidase__InfluenzaA__AEM92440
augaaccccaaucagaagaucauuaccaucggcagcgugugcauuacaaucgggauggccaaccugauucuccaaaucggaaauaucauuuccaucuggauuucucacagcauccagcugggcaaccagucccagauugagacguguaaucaaucugucaucaccuacgaaaacaauacauggguuaaccagaccuaugugaauauuagcaacacaaauuucgcugccgggcaguccguggucucugugaaacuugcgggaaacagcucccugugcccuguuagcggcugggcuaucuacucuaaggacaauuccaucagaauugggagcaaaggagauguguuugucauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggugccuagccccuacaacucccgcuuugaaucuguugccuggagcgcuuccgccugccacgacggaaucaacuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccaucaugacggauggaccgucugacggccaggccagcuacaaaaucuuucgcauugaaaagggcaaaaucgugaaguccgucgagaugauugcucccaacuaucauuacgaagagugcucuuguuacccugauagcuccgagaucacaugcguuugcagagacaauuggcacgggagcaaccggcccugggugucuuucaaucagaaccuggaauaucagauuggauacaucuguuccggcauuuuuggggauaauccucgccccaacgacaaaaccggaagcugcggcccggugucuuccaauggggccaacggagucaagggcuucagcuuuaaguauggcaaugggguguggaucggaagaacaaaauccaucucuagccggaagggcuucgagaugauuugggauccuaacggguggaccggaaccgacaacaauuuuuccaucaaacaagacauuguuggcaucaacgaauggucuggguacagcggcuccuucgugcagcaucccgagcuuacaggacuggauuguauucgcccuugcuucugggucgaacucaucagaggccggcccaaggagaauacgaucuggaccagcgggucuuccauuagcuuuuguggagugaacucugacacaguuggcugguccuggcccgauggggcugagcugccuuucaccaucgacaaauga

SEQ ID NO: 204026 - RNA, 1410 nt, Artificial Sequence; identical to SEQ ID NO: 203982
  derived and/or modified sequence opt5 from neuraminidase__InfluenzaA__AEM92450

SEQ ID NO: 204027 - RNA, 1410 nt, Artificial Sequence; identical to SEQ ID NO: 203982
  derived and/or modified sequence opt5 from neuraminidase__InfluenzaA__AEM92460

SEQ ID NO: 204028 - RNA, 1410 nt, Artificial Sequence; identical to SEQ ID NO: 203733
  derived and/or modified sequence opt5 from neuraminidase__InfluenzaA__AEM92470

SEQ ID NO: 204029 - RNA, 1410 nt, Artificial Sequence; identical to SEQ ID NO: 203733
  derived and/or modified sequence opt5 from neuraminidase__InfluenzaA__AEM92480

SEQ ID NO: 204030 - RNA, 1410 nt, Artificial Sequence
  derived and/or modified sequence opt5 from neuraminidase__InfluenzaA__AEM92490
augaaccccaaucagaagaucauuaccaucggcagcgugugcaugauuaucgggauggccaaccugaugcuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugccuggucugcuagcgccugccacgacggaauuaauuggcugacgaucggcaucuccgggccugauaacggagcuguggccguccugaaguauaauggcauuaucaccgacacaauuaagagcuggagaaacaauauccuccggacccaagagucugagugugcgugcgugaacggguccuguuucacaauuaugaccgauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacgugcguuugcagagacaauuggcacggguccaaccggcccugggugagcuucaaucagaaccuggaauaucagauuggauacaucuguucuggcauuuuuggggauaauccucgccccaacgacaaaacaggauccugcggcccggugagcucuaauggggccaacggagucaagggcuucuccuuuaaguauggcaacgggguguggaucggaagaaccaaaagcauuuccucucggaauggcuucgagaugaucugggauccuaacggguggacaggaaccgacaauaacuuuagcaucaagcaagacauuguuggcaucaaugaaugguccggguacucuggcagcuucgugcagcaucccgagcuuaccggacuggauuguauucgcccuugcuucugggucgaacucaucagaggccggcccaaagagaacacaauuuggacguccgggagcucuaucuccuuuuguggagugaauagcgacaccguuggcuggucuuggcccgauggggcugagcugccuuucacaaucgacaaguga

SEQ ID NO: 204031 - RNA, 1410 nt, Artificial Sequence
  derived and/or modified sequence opt5 from neuraminidase__InfluenzaA__AEM92500
augaaccccaaucagaagaucauuaccaucggcagcgugugcaugauuaucgggauggccaaccugaugcuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugccuggucugcuagcgccugccacgacggaauuaauuggcugacgaucggcaucuccgggccugauaacggagcuguggccguccugaaguauaauggcauuaucaccgacacaauuaagagcuggagaaacaauauccuccggacccaagagucugagugugcgugcgugaacggguccuguuucacaauuaugaccgauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacgugcguuugcagagacaauuggcacggguccaaccggcccugggugagcuucaaucagaaccuggaauaucagaugggauacauuuguucuggcaucuuuggggauaauccucgccccaacgacaaaacaggauccugcggcccggugagcucuaauggggccaacggagucaagggcuucuccuuuaaguauggcaacgggguguggauuggaagaaccaaaagcaucuccucucggaauggcuucgagaugauuugggauccuaacggguggacaggaaccgacaauaaguuuagcaucaaacaagacaucguuggcauuaacgaaugguccggguacucuggcagcuucgugcagcaucccgagcuuaccggacuggauuguauccgcccuugcuucugggucgaacucauuagaggccggcccaaggagaauacaaucuggacguccgggagcucuauuuccuuuuguggagugaacagcgacaccguuggcuggucuuggcccgauggggcugagcugccuuucacaaucgacaaauga

SEQ ID NO: 204032 - RNA, 1410 nt, Artificial Sequence
  derived and/or modified sequence opt5 from neuraminidase__InfluenzaA__AEM92520
augaaccccaaucagaagaucauuaccaucggcagcgugugcaugacaauugggauggccaaccugaugcuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucaucggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggcugagcugccuuucaccaucgacaaguga

SEQ ID NO: 204033 - RNA, 1410 nt, Artificial Sequence; identical to SEQ ID NO: 203733
  derived and/or modified sequence opt5 from neuraminidase__InfluenzaA__AEM92550

SEQ ID NO: 204034 - RNA, 1410 nt, Artificial Sequence
  derived and/or modified sequence opt5 from neuraminidase__InfluenzaA__AEM92570
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggaaauguguuugucauucgggagccguucaucagcuguucuccccucgaaugccgcaccuuuuuccugacacagggcgcccuucugaacgauaagcauuccaacggcaccauuaaagacagaagcccuuaucggacgcucaugucuugucccaucggggaggugccuucccccuacaauagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccauuaugacggacggaccgagcgauggccaggccucuuacaaaaucuuucgcaucgaaaagggcaaaauugucaagagcguggagaugaacgcucccaauuaucauuacgaagagugcuccuguuacccugacucuagcgagaucacaugcguuugcagagauaacuggcacggguccaaucggcccugggugagcuucaaccagaaucuggaauaucagauuggauacaucuguucuggcauuuuuggggacaacccucgccccaaugauaaaaccggauccugcggcccggugagcucuaacggggccaacggagucaagggcuucuccuuuaaguauggcaaugggguguggaucggaagaacaaaaagcauuuccucucggaagggcuucgagaugaucugggacccuaacggguggaccggaaccgauaauaacuuuagcaucaaacaagacauuguuggcaucaaugaaugguccggguacucuggcagcuucgugcagcaucccgagcuuacaggacuggacuguauucgcccuugcuucugggucgaacucaucagaggccggcccaaggagaacacgauuuggaccuccgggagcucuaucuccuuuuguggagugaauagcgauacaguuggcuggucuuggcccgacggggcugagcugccuuucaccaucgauaaauga

SEQ ID NO: 204035 - RNA, 1410 nt, Artificial Sequence
  derived and/or modified sequence opt5 from neuraminidase__InfluenzaA__AEM92580
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcaauggccaggccucuuacaaaaucuuucgcaucgaaaagggcaaaauugucaagagcguggagaugaacgcucccaauuaucauuacgaagagugcuccuguuacccugacucuagcgagaucacaugcguuugcagagauaacuggcacggguccaaucggcccugggugagcuucaaccagaaucuggaauaucagauuggauacaucuguucuggcauuuuuggggacaacccucgccccaaugauaaaaccggauccugcggcccggugagcucuaacggggccaacggagucaagggcuucuccuuuaaguauggcaaugggguguggaucggaagaacaaaaagcauuuccucucggaagggcuucgagaugaucugggacccuaacggguggaccggaaccgauaauaacuuuagcaucaaacaagacauuguuggcaucaaugaaugguccggguacucuggcagcuucgugcagcaucccgagcuuacaggacuggacuguauucgcccuugcuucugggucgaacucaucagaggccggcccaaggagaacacgauuuggaccuccgggagcucuaucuccuuuuguggagugaauagcgauacaguuggcuggucuuggcccgacggggcugagcugccuuucaccaucgauaaauga

SEQ ID NO: 204036 - RNA, 1410 nt, Artificial Sequence; identical to SEQ ID NO: 203733
  derived and/or modified sequence opt5 from neuraminidase__InfluenzaA__AEM92590

SEQ ID NO: 204037 - RNA, 1410 nt, Artificial Sequence; identical to SEQ ID NO: 203733
  derived and/or modified sequence opt5 from neuraminidase__InfluenzaA__AEM92600

SEQ ID NO: 204038 - RNA, 1410 nt, Artificial Sequence
  derived and/or modified sequence opt5 from neuraminidase__InfluenzaA__AEM92610
augaaccccaaucagaagaucauuaccaucggcagcgugugcaugacaauugggauggccaaccugaugcuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugucuugguccuggcccgauggcgcugagcugccuuucaccauugacaaguga

SEQ ID NO: 204039 - RNA, 1410 nt, Artificial Sequence
  derived and/or modified sequence opt5 from neuraminidase__InfluenzaA__AEM92620
augaaccccaaucagaagaucauuaccaucggcagcgugugcaugauuaucgggauggccaaccugaugcuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcacauuuuuccugacccagggcgcccuucuggacgauaagcauuccaauggcacaauuaaagacagaagcccuuaucggacccucaugucuugucccaucggggaggugccuucccccuacaacagccgcuuugaauccguugccuggucugcuagcgccugccacgauggaauuaacuggcugacgaucggcaucuccgggccugacaauggagcuguggccguccugaaguauaacggcauuaucaccgauacaauuaagagcuggagaaauaacauccuccggacccaagagucugagugugcgugcgugaauggguccuguuucacaauuaugaccgacggaccgagcgauggccaggccucuuacaaaaucuuucgcaucgaaaagggcaaaauugucaagagcguggagaugaacgcucccaauuaucauuacgaagagugcuccuguuacccugacucuagcgagaucacgugcguuugcagagauaacuggcacggguccaaucggcccugggugagcuucaaccagaaucuggaauaucagaugggauacauuuguucuggcaucuuuggggacaacccucgccccaaugauaaaacaggauccugcggcccggugagcucuaacggggccaauggagucaagggcuucuccuuuaaguauggcaacgggguguggauuggaagaaccaaaagcaucuccucucggaacggcuucgagaugauuugggacccuaauggguggacaggaaccgacaacaaguuuagcaucaaacaagauaucguuggcauuaaugaaugguccggguacucuggcagcuucgugcagcaucccgagcuuaccggacuggacuguauccgcccuugcuucugggucgaacucauuagaggccggcccaaggagaacacaaucuggacguccgggagcucuauuuccuuuuguggagugaauagcgauaccguuggcuggucuuggcccgacggggcugagcugccuuucacaaucgauaaauga

SEQ ID NO: 204040 - RNA, 1410 nt, Artificial Sequence
  derived and/or modified sequence opt5 from neuraminidase__InfluenzaA__AEM92650
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacacaaaguuuagcauuaaacaagacaucgucggcaucaaugaaugguccggguacucuggcagcuucgugcagcaucccgagcuuacgggacuggauuguauucgcccuugcuucuggguugaacucaucagaggccggcccaaggagaacaccauuuggacauccgggagcucuaucuccuuuuguggagugaauagcgacaccgucggcuggucuuggcccgauggggcugagcugccuuucacaauugacaaauga

SEQ ID NO: 204041 - RNA, 1410 nt, Artificial Sequence; identical to SEQ ID NO: 202434
  derived and/or modified sequence opt5 from neuraminidase__InfluenzaA__AEM98410

SEQ ID NO: 204042 - RNA, 1410 nt, Artificial Sequence; identical to SEQ ID NO: 202434
  derived and/or modified sequence opt5 from neuraminidase__InfluenzaA__AEM98421

SEQ ID NO: 204043 - RNA, 1410 nt, Artificial Sequence; identical to SEQ ID NO: 202434
  derived and/or modified sequence opt5 from neuraminidase__InfluenzaA__AEM98432

SEQ ID NO: 204044 - RNA, 1410 nt, Artificial Sequence; identical to SEQ ID NO: 203810
  derived and/or modified sequence opt5 from neuraminidase__InfluenzaA__AEN55401

SEQ ID NO: 204045 - RNA, 1410 nt, Artificial Sequence; identical to SEQ ID NO: 202037
  derived and/or modified sequence opt5 from neuraminidase__InfluenzaA__AEN55411

SEQ ID NO: 204046 - RNA, 1410 nt, Artificial Sequence
  derived and/or modified sequence opt5 from neuraminidase__InfluenzaA__AEN55421
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccagacaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugugugcgugaauggcagcuguuucaccauuaugacggaugggccgucugacggacaggcgagcuacaaaaucuuuagaaucgaaaagggcaaaauugucaaguccguugagaugaacgcccccaauuaucauuacgaagagugcucuuguuacccugauagcuccgagaucacaugcgugugccgggacaacuggcacggcagcaaucgccccugggugucuuucaaccagaaucuggaauaucagauuggguacaucuguuccggaauuuuuggcgauaacccuagacccaaugacaaaaccgggagcugcggaccggucucuuccaacggcgcuaauggggugaagggauucagcuuuaaguauggcaacggcguuuggaucgggcggacaaaauccauuucuagccgcaagggauucgagaugaucugggauccuaacggcuggaccgggaccgacaauaacuuuuccaucaaacaagacauugugggaaucaaugaauggucuggcuacagcggguccuucguccagcaucccgagcuuacaggccuggauuguauuagaccuugcuucuggguggaacucauccggggacgccccaaggagaacacgauuuggaccagcggcuccuccaucagcuuuugugggguuaauucugacacagugggaugguccuggcccgauggcgccgagcugccuuucaccaucgacaaauga

SEQ ID NO: 204047 - RNA, 1410 nt, Artificial Sequence
  derived and/or modified sequence opt5 from neuraminidase__InfluenzaA__AEN55466
augaaccccaaucagaagaucauuaccaucggcagcgugugcauuacaaucgggauggccaaccugauucuccaaaucggaaauacgaucuccauuuggaucucucacagcauucagcugggcaaccagaaucagaucgagaccuguaaccaauccgucauuacauacgaaaauaacaccuggguuaaucagacauaugugaacaucucuaauaccaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacgauuaaagauagaagcccuuaucggacccucaugucuugucccaucggggaggugccuucccccuacaacagccgcuuugaauccguugccuggucugcuagcgccugccacgacggaauuuccuggcugacaaucggcaucagcgggccugauaauggagcuguggccguccugaaguauaacggcauuaucaccgacacaauuaagucuuggagaaauaacauccuccggacccaagaguccgagugugcgugcgugaaugggagcuguuucacggugaugacagauggaccgucugacggccaggccagcuacaaaauuuuucgcaucgaaaagggcaaaaucgucaaguccguugagaugaacgcucccaauuaucauuacgaagagugcucuuguuacccugauagcuccgagauuaccugcgugugcagagacaacuggcacgggagcaaucggcccugggugucuuucaaccagaaucuggaauaucagaucggauacauuuguuccggcaucuuuggggauaacccucgccccaaugacaaaacaggaagcugcggcccggucucuuccaacggggccaauggagugaagggcuucagcuuuaaguauggcaacgggguuuggauuggaagaaccaaauccaucucuagccggaacggcuucgagaugauuugggauccuaauggguggaccggaacagacaacaauuuuuccaucaagcaagacaucgugggcauuaacgaauggucuggguacagcggcuccuucguccagcaucccgagcuuacgggacuggauuguauccgcccuugcuucuggguggaacucauuagaggccggcccaaagagaauaccaucuggacaagcgggucuuccauuagcuuuuguggaguuaacucugacaccgugggcugguccuggcccgauggggcugagcugccuuucacaaucgacaaguga

SEQ ID NO: 204048 - RNA, 1410 nt, Artificial Sequence
  derived and/or modified sequence opt5 from neuraminidase__InfluenzaA__AEN55476
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggaguuaauucugacacaguguccuggagcuggcccgauggcgcugagcugccuuucaccaucgacaaauga

SEQ ID NO: 204049 - RNA, 1410 nt, Artificial Sequence; identical to SEQ ID NO: 203281
  derived and/or modified sequence opt5 from neuraminidase__InfluenzaA__AEN55486

SEQ ID NO: 204050 - RNA, 1410 nt, Artificial Sequence; identical to SEQ ID NO: 203281
  derived and/or modified sequence opt5 from neuraminidase__InfluenzaA__AEN55506

SEQ ID NO: 204051 - RNA, 1410 nt, Artificial Sequence
  derived and/or modified sequence opt5 from neuraminidase__InfluenzaA__AEN55516
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagccggggagauguguuugucauucgcgagccguucaucucuuguagcccccucgaaugcagaaccuuuuuccugacacagggcgcccuucugaacgacaaacauuccaauggcaccauuaaggaucggucuccuuaucgcacgcucauguccugucccaucggggaggugccuagccccuacaacuccagauuugaaucuguugccuggagcgcuuccgccugccacgacggaauuaacuggcugaccaucggcaucagcgggccugauaauggagcuguggccguccugaaauauaacggcauuaucacagacaccauuaagucuuggcggaauaacauccuccgcacacaagaguccgagugugcgugcgugaaugggagcuguuucaccauuaugacggauggaccgucugacggccaggccagcuacaagaucuuuagaaucgaaaaaggcaagauugugaaauccgucgagaugaacgcucccaauuaucauuacgaagagugcucuuguuacccugauagcuccgagaucacaugcguuugccgggacaacuggcacgggagcaaucgccccugggugucuuucaaccagaaucuggaauaucagauuggauacaucuguuccggcauuuuuggggauaacccuagacccaaugacaagaccggaagcugcggcccggugucuuccaacggggccaauggagucaaaggcuucagcuuuaaguauggcaacgggguguggaucggacggacaaaguccauuucuagccgcaaaggcuucgagaugaucugggauccuaacggguggaccggaaccgacaauaacuuuuccaucaagcaagacauuguuggcaucaaugaauggucuggguacagcggcuccuucgugcagcaucccgagcuuacaggacuggauuguauuagaccuugcuucugggucgaacucauccggggccgccccaaagagaacacgauuuggaccagcgggucuuccaucagcuuuuguggaguuaauucugacacagugggcugguccuggcccgauggggcugagcugccuuucaccaucgacaaguga

SEQ ID NO: 204052 - RNA, 1410 nt, Artificial Sequence; identical to SEQ ID NO: 203281
  derived and/or modified sequence opt5 from neuraminidase__InfluenzaA__AEN55526

SEQ ID NO: 204053 - RNA, 1410 nt, Artificial Sequence; identical to SEQ ID NO: 203810
  derived and/or modified sequence opt5 from neuraminidase__InfluenzaA__AEN69429

SEQ ID NO: 204054 - RNA, 1410 nt, Artificial Sequence; identical to SEQ ID NO: 203807
  derived and/or modified sequence opt5 from neuraminidase__InfluenzaA__AEN69438

SEQ ID NO: 204055 - RNA, 1410 nt, Artificial Sequence; identical to SEQ ID NO: 202037
  derived and/or modified sequence opt5 from neuraminidase__InfluenzaA__AEN69484

SEQ ID NO: 204056 - RNA, 1410 nt, Artificial Sequence; identical to SEQ ID NO: 199709
  derived and/or modified sequence opt5 from neuraminidase__InfluenzaA__AEO01627

SEQ ID NO: 204057 - RNA, 1410 nt, Artificial Sequence; identical to SEQ ID NO: 199709
  derived and/or modified sequence opt5 from neuraminidase__InfluenzaA__AEO01638

SEQ ID NO: 204058 - RNA, 1410 nt, Artificial Sequence
  derived and/or modified sequence opt5 from neuraminidase__InfluenzaA__AEO01644
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaccgacagcuccucuagcggccauugccuggauccgaacaaugaggaagggggacacggcgucaaagggugggccuucgacgauggaaacgacguguggaugggccgcacaaucuccgagaagucuagacucggguaugagaccuuuaaaguuauugaaggauggucuaauccuaaguccaaacugcagaucaaccgccaggugauugucgaucggggcaauagaagcggcuacucugggaucuucuccguggagggaaagagcuguauuaaccggugcuuuuaugucgaacugaucagaggccgcaaggaggaaaccgaggugcucuggacauccaauucuauuguuguguucugugggaccagcggaacauacggcacgggguccuggcccgacggcgcugauaucaaccugaugccuaucuga

SEQ ID NO: 204059 - RNA, 1410 nt, Artificial Sequence
  derived and/or modified sequence opt5 from neuraminidase__InfluenzaA__AEO01654
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagauauucugcgcacccaggagucugaaugugucugcaucaaugggacauguacgguggugaugaccgacggauccgcuagcggcaaggccgauacaaaaauccucuuuauugaggaggggaagaucguccauaccuccacacugucuggaagcgcgcaacacguugaagagugcuccugcuauccuagauaccccggcgugcggugugugugccgcgacaacuggaaggggagcaacagaccuauugucgacaucaauauuaaagaucacucuaucguguccagcuacguuuguucuggacuugugggcgacacgccccggaagaacgauagcuccucuagcggccauugccuggacccgaauaacgaagagggagggcacggcgucaaagggugggccuucgaugacggaaaugauguguggaugggccgcaccaucuccgaaaagagcagacucggguaugagacauuuaaaguuauugagggauggucuaacccuaaguccaaacugcagaucaaucgccaggugauugucgaccggggcaacagaagcggcuacucugggaucuucuccguggaaggaaagagcuguauuaaucggugcuuuuaugucgagcugaucagaggccgcaaggaagagaccaaagugcucuggaccuccaacucuauuguuguguucugugggacaagcggaaccuacggcacaggguccuggcccgauggcgcugaaaucaaucugaugccuaucuga

SEQ ID NO: 204060 - RNA, 1413 nt, Artificial Sequence; identical to SEQ ID NO: 199656
  derived and/or modified sequence opt5 from neuraminidase__InfluenzaA__AEO01665

SEQ ID NO: 204061 - RNA, 1413 nt, Artificial Sequence
  derived and/or modified sequence opt5 from neuraminidase__InfluenzaA__AEO01676
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuaccguggauggcgccaacggggugaaaggauucuccuacaaguaugacaauggcgucuggaucgggcggacaaaaagcaaccgccugagaaagggauuugagaugauuugggaccccaauggcuggacgaacaccgauucugacuucuccgugaaacaggauguuguggcgaucacagacuggagcggguacuccggcucuuuuguccagcacccggaacucaccggacuggauugcauccggccuuguuucuggguggagcuuguucgcggccugcccagagaaaacacaaccauuuggacgagcggguccucuaucuucuuucggggagacaauagcgauacagccaacugguccuggccugacggcgcugagaugaccuucaccauugauaaguga

SEQ ID NO: 204062 - RNA, 1410 nt, Artificial Sequence; identical to SEQ ID NO: 199709
  derived and/or modified sequence opt5 from neuraminidase__InfluenzaA__AEO01693

SEQ ID NO: 204063 - RNA, 1413 nt, Artificial Sequence; identical to SEQ ID NO: 199656
  derived and/or modified sequence opt5 from neuraminidase__InfluenzaA__AEO01711

SEQ ID NO: 204064 - RNA, 1410 nt, Artificial Sequence; identical to SEQ ID NO: 203832
  derived and/or modified sequence opt5 from neuraminidase__InfluenzaA__AEO37533

SEQ ID NO: 204065 - RNA, 1410 nt, Artificial Sequence
  derived and/or modified sequence opt5 from neuraminidase__InfluenzaA__AEO37543
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagccuuguaaccaauccgucauuacguacgaaaauaacaccuggguuaaucagacauaugugaacaucucuaauaccaacuucgcugccgggcagagcguggucuccgugaaacuugcgggaaauucuagccugugcccgguuuccggcugggcuauuuacagcaaggacaacucuaucagaaucggguccaaaggagauguguuugucauucgggagcccuucaucagcuguucuccucucgaaugccgcacauuuuuccugacccagggcgcccuucugaaugacaagcauuccaacggcacaauuaaagauagaagccccuaucggacccucaugucuuguccuaucggggaggugcccuccccuuacaacagccgcuuugaauccguugccuggucugcuagcgccugccacgacggaauuaauuggcugacgaucggcaucuccgggccggauaacggagcuguggccguccugaaguauaauggcauuaucaccgacacaauuaagagcuggagaaacaauauccuccggacccaagagucugagugugcgugcgugaacggguccuguuucacagugaugaccgauggacccagcgacggccaggccucuuacaaaauuuuucgcaucgaaaagggcaaaaucgucaagagcguugagaugaaugcuccuaacuaucauuacgaagagugcuccuguuaccccgauucuagcgagauuacgugcgugugcagagacaauuggcacggguccaaccggccuugggugagcuucaaucagaaccuggaauaucagaucggauacauuuguucuggcaucuuuggggauaauccccgcccgaacgacaaaacaggauccugcggcccugucagcucuaauggggccaacggagugaagggcuucuccuuuaaguauggcaacgggguuuggauuggaagaaccaaaagcaucuccucucggaauggcuucgagaugauuugggaucccaacggguggacaggaaccgacaauaacuuuagcgugaagcaagacaucaucggcauuaaugaaugguccggguacucuggcagcuucguccagcauccugagcuuaccggacuggauuguauccgccccugcuucuggguggaacucauuagaggccggcccaaagagaacacaaucuggacguccgggagcucuauuuccuuuuguggaguuaauagcgacaccgugggcuggucuuggccugauggggcugagcugccguucacaaucgacaaguga

SEQ ID NO: 204066 - RNA, 1410 nt, Artificial Sequence; identical to SEQ ID NO: 203281
  derived and/or modified sequence opt5 from neuraminidase__InfluenzaA__AEO72179

SEQ ID NO: 204067 - RNA, 1350 nt, Artificial Sequence
  derived and/or modified sequence opt5 from neuraminidase__InfluenzaA__AEO88957
augaaccccaaucagaagaucauuaccaucggcagcauuugcauggugaucgggauugucucccugaugcuccaaaucggaaacaugaucucuauuuggguuagccacuccacacagacgggcaaucagcaucaggccgagccuaucagaaacaccaauuuccugacagaaaacgcuguggccucugugacccuugcggggaauagcucccuguguccgauucggggaugggcuguccacucuaaagacaacagcauccgcauuggcuccaagggggauguguuuguuaucagagagcccuucauuagcugcucucaucucgaaugucggacauuuuuccugacccaaggagcccuucugaaugacaaacacuccaacggcacagugaaggaucgcagcccucauagaacccucaugucuugccccgucggcgaggccccuucccccuacaauagccgguuugaaucuguggcuugguccgccagcgcuugucacgacgggacguccuggcugaccaucggaaucucuggcccugauaacggggccguugcggugcugaaauauaauggaauuaucacagacaccauuaagagcuggcgcaacaauauccucagaacacaggaguccgagugcgccugugucaacggcagcugcuucaccgugaugacggaugggccgucuaacggacaggcuuccuacaagauuuuuaaaauggaaaagggcaaaguggucaagagcguugagcugaaugcccccaacuaucacuacgaagaguguucuugcuauccugacgcuggcgagaucaucugugugugccgggauaauuggcaugggagcaaccgccccuggguguccuucaaucagaaccuugaauaccaaauuggauauaucugcucuggcgucuuuggggacaauccuagacccaacgauggaacaggcagcugugggccgguguccccuaauggagccuacggcauuaaaggcuucagcuuuaaguacgggaacggaguuuggaucggccggaccaagucuacaaauucccgcagcggguucgagaugauuugggaccccaacggauggaccggcaccgauucuaauuuuuccgugaaacaggacaucgucgcgaucacagacuggagcggguauuccggcucuuucgugcagcacccugaacugacgggacucgauugcauuagacccuguuucuggguugagcugauccggggccgccccaaggaaagcaccauuuggacauccgggucuagcaucuccuuuugcggagugaacagcgacaccgucucuugguccuggccugauggcgccgagcuuccguucacaauugacaaauga

SEQ ID NO: 204068 - RNA, 1350 nt, Artificial Sequence
  derived and/or modified sequence opt5 from neuraminidase__InfluenzaA__AEO88965
augaaccccaaucagaagaucauuaccaucggcagcauuugcauggugaucgagauugucucccugaugcuccaaaucgggaacaugaucucuauuuggguuagccacuccauccagacgaaaaaucagagacaggccgaaccuauuucuaacacaaaguuccugaccgagaaagcuguggccagcgugacacuugcgggaaauuccucucuguguccgaucagcggcugggcuguccauuccaaggacaacagcauucggaucgggucuaaaggagauguguuuguuauucgcgaacccuucaucuccugcagccaccucgaguguagaaccuuuuuccugacacaaggcgcccuucugaaugacaagcauucuaacgggaccgugaaggaucgguccccucaccgcacacucaugagcugccccgucggagaagccccuucucccuacaauuccagauuugagagcguggcuugguccgccucugcuugucaugacggcaccagcuggcugacgaucggcauuuccgggccugauaacggagccguugcggugcugaaauauaauggcaucauuaccgacacaaucaagagcuggcggaacaauauucuccgcacccaggagucugaaugcgccugugucaacggguccugcuucacagugaugaccgauggaccgagcaauggccaggcuucuuacaaaaucuuuaagauggagaaagggaagguggucaagagcguugaacuggacgcccccaacuaucacuacgaggaguguuccugcuauccugaugcuggagaaaucacgugugugugcagagacaacuggcacggcucuaaucggcccugggugagcuucaaccagaaucuugaguaccaaauuggcuauaucugcuccggggucuuuggagauaacccucgccccaaugacggcacagggagcuguggaccggugucuccuaacggcgccuacgggguuaaaggauucuccuuuaaguacggcaauggcguguggauugggagaaccaaaagcacaaacucucgguccggauucgaaaugaucugggaucccaauggcuggaccgggaccgacagcuccuuuucugucaagcaggacauuguggcgaucacagauuggagcggauauuccggcucuuucguucagcauccugagcugacggggcucaacugcauccgccccuguuucuggguggaacuggucagaggccggcccaaagagagcaccauuuggacauccggaagcucuaucuccuuuugcggcgugaauagcgacaccgucggguggucuuggccugauggagccgagcuuccguucacaauugacaaguga

SEQ ID NO: 204069 - RNA, 1350 nt, Artificial Sequence
  derived and/or modified sequence opt5 from neuraminidase__InfluenzaA__AEO88973
augaaccccaaucagaagaucauuaccaucggcagcauuugcauggugaucgggauugucucccugaugcuccaaaucggaaacaugaucucucuguggguuagccacuccauucagacaggcaaucagcaucagguggagccuaucucuaacacgaauuuccuuaccgaaaaagccguggcuagcgucacacuggccgggaacuccucucucuguccgauuagaggaugggcggugcacagcaaggacaauuccauccggauuggcagcaaaggggauguuuuugugauccgcgagcccuucauuucuugcucccaucuggaauguagaaccuuuuuccuuacacaaggagcucugcucaacgacaagcacagcaauggcaccgucaaagaucggucuccucaucgcacacugauguccugccccgugggcgaggccccuagccccuacaacucuagauuugaauccguugccuggagcgcuuccgccugucacgacgggaccucuuggcugacgaucggaaucagcggcccugauaauggggcuguggccguccucaaguauaacggaaugauuaccgacacaaucaaguccuggcggaauaacauucugcgcacccaggagagcgagugcgcgugugugaauggcucuugcuucacagugaugaccgaugggccguccaacggacaggccagcuacaaaaucuuuaagauggaaaaaggcagagucguuaagucuguggagcuugacgcucccaacuaucacuacgaagaguguagcugcuauccugaugccggcgagauuacgugugugugccgggacaauuggcauggguccaaccgccccugggucucuuucaaucagaaccuggaauaccaaaucggauauaucugcagcggcguguuuggggauaauccuagacccaacgacggaacaggcuccugugggccgguuagcccuaauggagcuuacggcgugaaaggcuucucuuuuaaguacgggaacggagucuggauuggccggaccaagucccccaauagccgcucuggguucgagaugaucugggauccuaacggauggauugaaacagacuccagcuuuuccgugaaacaggacaucguugccauuaccgauuggucuggcuauagcggguccuucgugcagcaccccgagcucaccggccuggacugcaucagacccuguuucugggucgaacuuauccggggacgcccuaaggagucuacaauuuggacgagcggcuccagcaucucuuuuugcggggucaauuccgauaccgugagcuggucuuggccggacggagcggagcugcccuucacaauugauaaauga

SEQ ID NO: 204070 - RNA, 1350 nt, Artificial Sequence
  derived and/or modified sequence opt5 from neuraminidase__InfluenzaA__AEO88982
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgguccggggaugggcugugcacucuaaagacaacagcauccgcauuggcuccaagggggauguuuuugugaucagagagcccuucauuagcugcucucaucucgaaugucggaccuuuuuccugacacaaggagcccuucugaaugacaaacacuccaacggcaccgucaaggaucgcagcccucauagaacacucaugucuugccccgugggcgaggccccuucccccuacaauagccgguuugaaucuguugcuugguccgccagcgcuugucacgacgggaccuccuggcugacgaucggaaucucuggcccugauaacggggccguggcgguccugaaauauaauggaauuaucaccgacacaauuaagagcuggcgcaacaauauccucagaacccaggaguccgagugcgccugugugaacggcagcugcuucacagugaugaccgaugggccgucuaacggacaggcuuccuacaagauuuuuaaaauggaaaagggcaaagucguuaagagcguggagcugaaugcccccaacuaucacuacgaagaguguucuugcuauccugacgcuggcgagaucacgugugugugccgggauaauuggcaugggagcaaccgccccugggucuccuucaaucagaaccuugaauaccaaaucggauauauuugcucuggcaucuuuggggacaauccuagaccccacgauggaacaggcagcugugggccgguguccccuaacggagccuacggcauuaaaggcuucagcuuuaaguacgggaauggaguuuggaucggccggaccaagucuacaaacucccgcagcggguucgagaugauuugggaccccaauggauggaccggcaccgauucuaacuuuuccgugaaacaggacaucgucgcgaucacagacuggagcggguauuccggcucuuucgugcagcauccugaacugacgggacucgauugcauuagacccuguuucuggguugagcugauccggggccgccccaaggaaagcaccauuuggacauccgggucuagcaucuccuuuugcggagugaauagcgacaccgucucuugguccuggccugaugacgccgagcuuccguucacaauugauaaauga

SEQ ID NO: 204071 - RNA, 1350 nt, Artificial Sequence
  derived and/or modified sequence opt5 from neuraminidase__InfluenzaA__AEO88990
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgguccggggaugggcugugcacucuaaagacaacagcauccgcauuggcuccaagggggauguuuuugugaucagagagcccuucauuagcugcucucaucucgaaugucggaccuuuuuccugacacaaggagcccuucugaaugacaaacacuccaacggcaccgucaaggaucgcagcccucauagaacacucaugucuugccccgugggcgaggccccuucccccuacaauagccgguuugaaucuguugcuugguccgccagcgcuugucacgacgggaccuccuggcugacgaucggaaucucuggcccugauaacggggccguggcgguccugaaauauaauggaauuaucaccgacacaauuaagagcuggcgcaacaauauccucagaacccaggaguccgagugcgccugugugaacggcagcugcuucacagugaugaccgaugggccgucuaacggacaggcuuccuacaagauuuuuaaaauggaaaagggcaaagucguuaagagcguggagcugaaugcccccaacuaucacuacgaagaguguucuugcuauccugacgcuggcgagaucacgugugugugccgggauaauuggcaugggagcaaccgccccugggucuccuucaaucagaaccuugaauaccaaaucggauauauuugcucuggcguguuuggggacaauccuagacccaacgauggaacaggcagcugugggccgguuuccccuaauggagccuacggcaucaaaggcuucagcuuuaaguacgggaacggaguguggauuggccggaccaagucuacaaauucccgcagcggguucgagaugaucugggaccccaacggauggaccggcaccgauucuaauuuuuccgucaaacaggacauuguggcgaucacagacuggagcggguauuccggcucuuucguucagcacccugaacugacgggacucgauugcaucagacccuguuucuggguggagcugauucggggccgccccaaggaaagcaccaucuggacauccgggucuagcauuuccuuuugcggagucaacagcgacaccgugucuugguccuggccugaugacgccgagcuuccguucacaaucgauaaauga

SEQ ID NO: 204072 - RNA, 1350 nt, Artificial Sequence
  derived and/or modified sequence opt5 from neuraminidase__InfluenzaA__AEO88998
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgauccggggaugggcuguccacucuaaagacaacagcauucgcaucggcuccaagggggauguguuuguuauuagagagcccuucaucagcugcucucaucucgaaugucggaccuuuuuccugacacaaggagcccuucugaaugacaaacacuccaacggcaccgugaaggaucgcagcccucauagaacacucaugucuugccccgucggcgaggccccuucccccuacaauagccgguuugaaucuguggcuugguccgccagcgcuugucacgacgggaccuccuggcugacgaucggaauuucuggcccugauaacggggccguugcggugcugaaauauaauggaaucauuaccgacacaaucaagagcuggcgcaacaauauucucagaacccaggaguccgagugcgccugugucaacggcagcugcuucacagugaugaccgaugggccgucuaacgaacaggcuuccuacaagaucuuuaaaauggagaagggaaaaguggucaagagcguugaacugaaugcccccaacuaucacuacgaggaguguucuugcuauccugacgcuggcgaaaucauuugugugugccgggauaauuggcauggcagcaaccgccccuggguguccuucaaucagaaccuugaguaccaaaucggguauauuugcucuggagucuuuggcgacaauccuagacccaacgaugggacgggaagcuguggcccgguguccccuaauggggccuacggaaucaaaggcuucagcuuuaaguacggcaacgggguuuggauuggacggacaaagucuaccaauucccgcagcggcuucgaaaugaucugggaccccaacggguggacaggaaccgauucuaauuuuuccgugaaacaggacaucgucgcgauuaccgacuggagcggcuauuccgggucuuucgugcagcacccugagcugacaggccucgauugcaucagacccuguuucuggguugaacugauucggggacgccccaaggagagcacgaucuggaccuccggcucuagcauuuccuuuugcggggugaacagcgacacagucucuugguccuggccugauggagccgagcuuccguucaccaucgacaaauga

SEQ ID NO: 204073 - RNA, 1350 nt, Artificial Sequence
  derived and/or modified sequence opt5 from neuraminidase__InfluenzaA__AEO89006
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgguccggggaugggcugugcacucuaaagacaacagcauccgcauuggcuccaagggggauguuuuugugaucagagagcccuucauuagcugcucucaucucgaaugucggaccuuuuuccugacacaaggagcccuucugaaugacaaacacuccaacggcaccgucaaggaucgcagcccucauagaacacucaugucuugccccgugggcgaggccccuucccccuacaauagccgguuugaaucuguugcuugguccgccagcgcuugucacgacgggaccuccuggcugacgaucggaaucucuggcccugauaacggggccguggcgguccugaaauauaauggaauuaucaccgacacaauuaagagcuggcgcaacaauauccucagaacccaggaguccgagugcgccugugugaacggcagcugcuucacagugaugaccgaugggccgucuaacggacaggcuuccuacaagauuuuuaaaauggaaaagggcaaagucguuaagagcguggagcugaaugcccccaacuaucacuacgaagaguguucuugcuauccugacgcuggcgagaucacgugugugugccgggauaauuggcaugggagcaaccgccccugggucuccuucaaucagaaccuugaauaccaaaucggauauauuugcucuggcguguuuggggacaauccuagacccaacgauggaacaggcagcugugggccgguuuccccuaauggagccuacggcaucaaaggcuucagcuuuaaguacgggaacggaguguggauuggccggaccaagucuacaaauucccgcagcggguucgagaugaucugggaccccaacggauggaccggcaccgauucugacuuuuccgucaaacaggacauuaucgcgaucacagauuggagcggguauuccggcucuuucgugcagcacccugaacugacgggacucgacugcauuagacccuguuucuggguugagcugauccggggccgccccaaggaaagcaccauuuggacauccgggucuagcaucuccuuuugcggagugaauagcgauaccgucucuugguccuggccugacggcgccgagcuuccguucacaauugauaaauga

SEQ ID NO: 204074 - RNA, 1350 nt, Artificial Sequence
  derived and/or modified sequence opt5 from neuraminidase__InfluenzaA__AEO89023
augaaccccaaucagaagaucauuaccaucggcagcauuugcauggugaucgggauugucucccugaugcuccaaaucggaaacaugguuucucugugggugagccacuccauccagacaggcaaucagcaucagguggagccuauuucuaacacgaauuuccuuaccgaaaaagccgucgcuagcgugacacuggccgggaacuccucucucuguccgaucagaggaugggcgguucacagcaaggacaauuccauucggaucggcagcaaaggggauguguuugucauucgcgagcccuucaucucuugcucccaucuggaauguagaaccuuuuuccuuacacaaggagcucugcucaacgacaagcacagcaauggcaccgugaaagaucggucuccucaucgcacacugauguccugccccguuggcgaggccccuagccccuacaacucuagauuugaauccguggccuggagcgcuuccgccugucacgacgggaccucuuggcugacgauuggaaucagcggcccugauaauggggcugucgccgugcucaaguauaacggaaugaucaccgacacaauuaaguccuggcggaauaacauccugcgcacccaggagagcgagugcgcgugugugaauggcucuugcuucacagucaugaccgaugggccguccaacggacaggccagcuacaaaauuuuuaagauggaaaaaggcaagguugugaaaucuguggagcuugacgcucccaacuaucacuacgaagaguguagcugcuauccugaugccggcgagaucacgugugucugcagagacaauuggcauggguccaaccggcccugggugucuuucaaucagaaccuggaauaccaaauuggauauaucugcagcggcguuuuuggggauaauccucgccccaacgacggaacaggcuccugugggccggugagcccuaauggagcuuacggcgucaagggcuucucuuuuaaguacgggaacggaguguggaucggcagaaccaaaucccccagcucucgguccggguucgagaugauuugggauccuaauggauggacagaaaccgacagcuccuuuucuguuaagcaggacaucguggccauuaccgauuggagcggcuauuccgggucuuucguccagcaccccgagcucacaggccuggacugcauccgccccuguuucuggguggaacuuauuagaggacggccuaaagagagcacgaucuggaccuccggcagcucuaucuccuuuugcggggucaacagcgauacagugucuugguccuggccggacggagcggagcugcccuucaccauugauaaguga

SEQ ID NO: 204075 - RNA, 1350 nt, Artificial Sequence
  derived and/or modified sequence opt5 from neuraminidase__InfluenzaA__AEO89032
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgguccggggaugggcugugcacucuaaagacaacagcauccgcauuggcuccaagggggauguuuuugugaucagagagcccuucauuagcugcucucaucucgaaugucggaccuuuuuccugacacaaggagcccuucugaaugacaaacacuccaacggcaccgucaaggaucgcagcccucauagaacacucaugucuugccccgugggcgaggccccuucccccuacaauagccgguuugaaucuguugcuugguccgccagcgcuugucacgacgggaccuccuggcugacgaucggaaucucuggcccugauaacggggccguggcgguccugaaauauaauggaauuaucaccgacacaauuaagagcuggcgcaacaauauccucagaacccaggaguccgagugcgccugugugaacggcagcugcuucacagugaugaccgaugggccgucuaacggacaggcuuccuacaagauuuuuaaaauggaaaagggcaaagucguuaagagcguggagcugaaugcccccaacuaucacuacgaagaguguucuugcuauccugacgcuggcgagaucacgugugugugccgggauaauuggcaugggagcaaccgccccugggucuccuucaaucagaaccuugaauaccaaaucggauauauuugcucuggcguguuuggggacaauccuagacccaacgauggaacaggcagcugugggccgguuuccccuaauggagccuacggcaucaaaggcuucagcuuuaaguacgggaacggaguguggauuggccggaccaagucuacaaauucccgcagcggguucgagaugaucugggaccccaacggauggaccggcaccgauucuaauuuuuccgucaaacaggacauuguggcgaucacagacuggagcggguauuccggcucuuucguucagcacccugaacugacgggacucgauugcaucagacccuguuucuggguggagcugauucggggccgccccaaggaaagcaccaucuggacauccgggucuagcauuuccuuuugcggagucaacagcgacaccgugucuugguccuggccugauggcgccgagcuuccguucacaaucgacaaauga

SEQ ID NO: 204076 - RNA, 1350 nt, Artificial Sequence
  derived and/or modified sequence opt5 from neuraminidase__InfluenzaA__AEO89041
augaaccccaaucagaagaucauuaccaucggcagcauuugcauggugaucgggcuggucucccucaugcugcaaauuggaaacaugaucucuaucuggguuagccacuccauucagacaggcaaucagcaucaggccgagccuaucagaaacacgaauuuccuuaccgaaaacgcuguggccucugugacacuggcggggaauagcucccucuguccgguccggggaugggcugugcacucuaaagacaacagcauucgcaucggcuccaagggggauguuuuugugauuagagagcccuucaucagcugcucucaucuggaaugucggaccuuuuuccuuacacaaggagcccugcucaaugacaaacacuccaacggcaccgucaaggaucgcagcccucauagaacacugaugucuugccccgugggcgaggccccuucccccuacaauagccgguuugaaucuguugcuugguccgccagcgcuugucacgacgggaccuccuggcugacgauuggaaucucuggcccugauaacggggccguggcgguccucaaauauaauggaaucauuaccgacacaaucaagagcuggcgcaacaauauucugagaacccaggaguccgagugcgccugugugaacggcagcugcuucacagugaugaccgaugggccgucuaacggacaggcuuccuacaagaucuuuaaaauggaaaagggcaaagucguuaagagcguggagcuuaaugcccccaacuaucacuacgaagaguguucuugcuauccugacgcuggcgagauuacgugugugugccgggauaauuggcaugggagcaaccgccccugggucuccuucaaucagaaccuggaauaccaaaucggauauaucugcucuggcguguuuggggacaauccuagacccaacgauggaacaggcagcugugggccgguuuccccuaauggagccuacggcauuaaaggcuucagcuuuaaguacgggaacggaguguggaucggccggaccaagucuacaaauucccgcagcggguucgagaugauuugggaccccaacggauggaccggcaccgauucuaauuuuuccgucaaacaggacaucguggcgauuacagacuggagcggguauuccggcucuuucguucagcacccugaacucacgggacuggauugcaucagacccuguuucuggaucgagcuuauucggggccgccccaaggaaagcaccaucuggacauccgggucuagcauuuccuuuugcggagugaacagcgacaccgucucuugguccuggccugauggcgccgagcugccguucacaaucgacaaauga

SEQ ID NO: 204077 - RNA, 1350 nt, Artificial Sequence
  derived and/or modified sequence opt5 from neuraminidase__InfluenzaA__AEO89050
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacacgaauuuccugaccgaaaacgcuguggccucugugacacuugcggggaauagcucccuguguccgauccggggaugggcuguccacucuaaagacaacagcauucgcaucggcuccaagggggauguguuuguuauuagagagcccuucaucagcugcucucaucucgaaugucggaccuuuuuccugacacaaggagcccuucugaaugacaaacacuccaacggcaccgugaaggaucgcagcccucauagaacacucaugucuugccccaugggcgaggccccuucccccuacaauagccgguuugaaucugucgcuugguccgccagcgcuugucacgacgggaccuccuggcugacgaucggaauuucuggcccugauaacggggccguggcgguucugaaauauaauggaaucauuaccgacacaaucaagagcuggcgcaacaauauucucagaacccaggaguccgagugcgccugugugaacggcagcugcuucacagucaugaccgaugggccgucuaacggacaggcuuccuacaagaucuuuaaaauggaaaagggcaaaguggucaagagcguggagcugaaugcccccaacuaucacuacgaagaguguucuugcuauccugacgcuggcgagaucauuuguguuugccgggauaauuggcaugggagcaaccgccccuggguguccuucaaucagaaccuugaauaccaaaucggauauauuugcucuggcguguuuggggacaauccuagacccaacgauggaacgggcagcugugggccggucuccccuaauggagccuacggcaucaaaggcuucagcuuuaaguacgggaacggaguguggauuggccggacaaagucuaccaauucccgcagcggguucgagaugaucugggaccccaacggauggacaggcaccgauucugacuuuuccguuaaacaggacaucguggcgauuaccgauuggagcggguauuccggcucuuucguccagcacccugaacugacaggacucgacugcaucagacccuguuucuggguggagcugauucggggccgccccaaggaaagcacgaucuggaccuccgggucuagcauuuccuuuugcggaguuaauagcgauacagugucuugguccuggccugacggcgccgagcuuccguucaccaucgauaaauga

SEQ ID NO: 204078 - RNA, 1350 nt, Artificial Sequence
  derived and/or modified sequence opt5 from neuraminidase__InfluenzaA__AEO89058
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucucgcggggauguguuuguuauuagagagcccuucaucuccugcagccaucucgaaugucggaccuuuuuccugacacaaggagcccuucugaaugacaagcacucuaacggcaccgugaaagaucgcuccccucauagaacacucaugagcugccccgucggcgaggccccuucucccuauaauucccgguuugaaagcguggcuugguccgccucugcuugucacgacgggaccagcuggcugacgaucggaauuuccggcccugauaacggggccguugcggugcugaaguacaauggaaucauuaccgacacaaucaagagcuggcgcaacaauauucucagaacccaggagucugagugcgccugugucaacggcuccugcuucacagugaugaccgaugggccgagcaauggacaggcuucuuauaaaaucuuuaagauggaaaaaggcaagguggucaaaagcguugagcuggacgcccccaacuaccauuaugaagaguguuccugcuacccugaugcuggcgagaucacgugugugugccgggacaacuggcacgggucuaaucgccccugggugagcuucaaccagaaucuugauuaucaaauuggauacaucugcuccggcgucuuuggggacaacccuagacccaaugauggaacaggcagcugugggccggugucuccuaacggagccuacggcguuaagggcuucuccuuuaaguaugggaauggaguguggauuggccggaccaaaagcacaaacucucgcuccggguucgaaaugaucugggaccccaauggauggaccggcaccgacagcuccuuuucugucaagcaggauauuguggcgaucacagacuggagcggguacuccggcucuuucguucagcacccugagcugacgggacucgauugcaucagacccuguuucuggguggaacugauucggggccgccccaaagagagcaccaucuggacauccgggagcucuauuuccuuuugcggagucaacagcgacaccgugucuugguccuggccugauggcgccgaacuuccguucacaaucgacaaguga

SEQ ID NO: 204079 - RNA, 1350 nt, Artificial Sequence
  derived and/or modified sequence opt5 from neuraminidase__InfluenzaA__AEO89075
augaaccccaaucagaagaucauuaccaucggcagcauuugcauggugaucgggauugucucccugaugcuccaaaucggaaacaugaucucuauuuggguuagccacuccauccagagaggcaaucugaaccagguggagccuauuucuaauacaaacuuccuuacggaaaaagccguggcuagcgucacccuggccggaaauuccucucucuguccgauccgggggugggcgauucauagcaaggacaacuccauccgcauuggcagcaaaggggauguguuuguuaucagagagcccuucaucucuugcucccaccuggaaugucggacauuuuuccuuacccagggagcucugcucaaugacaagcauagcaacggcacagugaaagaucgcucuccucacagaacccugauguccugccccgucggcgaggugccuagccccuacaauucucgguuugaauccguugccuggagcgccuccgcuugucaugacgggacaucuuggcugaccauuggaaucagcggcccugauaacggggccguggcugucgugaaguauaauggaauuaucacggacaccauuaaguccuggcgcaacaauauccucagaacacaagagagcgagugcgccugugugaacggcucuugcuucaccgucaugacagaugggccguccaacggacaggcgagcuacaaaaucuuuaagauggaaaaaggcaagguuauuaaaucuguggagcuggacgcccccaauuaucacuacgaagaguguagcugcuauccugaugcuggcgagaucaccugugugugccgggacaacuggcacggguccaaucgccccugggucucuuucaaccagaaucuugaauaccagauuggauauaucugcagcggcguguuuggggauaacccuagacccaaugacggaacgggcuccugugggccgguuagcccuaacggagccuacggcgugaagggcuucucuuuuaaguacgggaauggagucuggauuggccggacaaaaucccccaacagccgcucuggguucgagaugaucugggauccuaauggaugguccgaaaccgacagcuccuuuucugugaagcaagacaucguugcuauuacagauuggagcggcuauuccgggucuuucgugcagcaucccgagcugaccggccucgacugcaucagacccuguuucugggucgaacugauucggggacgcccuaaagagagcaccaucuggacauccggcagcucuauuuccuuuugcggggugaacagcgauacggucucuugguccuggccggacggagccgagcuucccuucaccaucgauaaguga

SEQ ID NO: 204080 - RNA, 1350 nt, Artificial Sequence
  derived and/or modified sequence opt5 from neuraminidase__InfluenzaA__AEO89084
augaaccccaaucagaagaucauuaccaucggcagcauuugcauggugaucgggauugucucccugaugcuccaaaucggaaacaugaucucuauuuggaucagcuacuccauucagacaggcaaucagcaccaggccgagccuacgagaaacgcuaccuuccugacagaaaaugccguugcgucugugacccuugcugggaacagcucccuguguccggugcggggaugggccguccauucuaaagacaauagcauccgcauuggcuccaagggggauguguuuguuaucagagagcccuucauuagcugcucucaccucgaaugucggacauuuuuccugacccaaggagcccuucugaacgacaaacauuccaauggcacagugaaggaucgcagcccucacagaacccucaugucuugccccgucggcgaggcuccuucccccuauaacagccgguuugaaucuguggccugguccgcuagcgccugucaugacgggacguccuggcugaccaucggaaucucuggcccugauaauggggcgguugccgugcugaaauacaacggaauuaucacagacaccauuaagagcuggcgcaauaacauccucagaacacaggaguccgagugcgcuugugucaauggcagcugcuucaccgugaugacggaugggccgucugacggacaggccuccuauaagauuuuuaaaauggaaaagggcaaaguggucaagagcguugagcugaucgcucccaacuaccacuaugaagaguguucuugcuacccugaugccggcgagaucacaugugugugccgggacaacuggcacgggagcaaucgccccuggguguccuucaaccagaaucuugaauaucaaauuggauacaucugcucuggcgucuuuggggauaacccuagacccaaugacggaaccggcagcugugggccgguguccccuaacggagcguacggcauuaaaggcuucagcuuuaaguaugggaauggaguuuggaucggccggacaaagucuaccaacucccgcagcggguucgagaugauuugggaucccaauggauggaccgaaacagacucuaacuuuuccgugaaacaggacaucgucgccaucacggauuggagcggcuacuccgggucuuucgugcagcauccugagcugaccggccucgacugcauuagacccuguuucuggguugaacugauccggggacgccccaaggagagcacaauuuggaccuccggcucuagcaucuccuuuugcggggugaauagcgauacagucucuugguccuggccugacggagcugagcuuccguucaccauugauaaauga

SEQ ID NO: 204081 - RNA, 1350 nt, Artificial Sequence
  derived and/or modified sequence opt5 from neuraminidase__InfluenzaA__AEO89093
augaaccccaaucagaagaucauuaccaucggcagcauuugcauggugaucgggauugucucccugaugcuccaaaucggaaacaugaucucucuguggguuagccacuccauucagacaggcaaucagcaucagguggagccuaucucuaacacgaauuuccuuguggaaaaagccgucgcuagcgugacccuggccgggaacuccucucucuguccgauuagaggaugggcgguucacagcaaggacaauuccauccggauuggcagcaaaggggauguguuugucauccgcgagcccuucauuucuugcucccaucuggaauguagaacauuuuuccuuacccaaggagcucugcucaacgacaagcacagcaauggcacagugaaagaucggucuccucaucgcacccugauguccugccccguuggcgaggccccuagccccuacaacucuagauuugaauccguggccuggagcgcuuccgccugucacgacgggacaucuuggcugaccaucggaaucagcggcccugauaauggggcugucgccgugcucaaguauaacggaaugauuacggacaccaucaaguccuggcggaauaacauucugcgcacacaggagagcgagugcgcgugugugaauggcucuugcuucaccgucaugacagaugggccguccaacggacaggccagcuacaaaaucuuuaagauggaaaaaggcagaguugugaagucuguggagcuugacgcucccaacuaucacuacgaagaguguagcugcuauccugaugccggcgagauuaccugugucugccgggacaauuggcauggguccaaccgccccugggugucuuucaaucagaaccuggaauaccaaaucggauauaucugcagcggcguuuuuggggauaauccuagacccaacgacggaacgggcuccugugggccggugagcucuaauggagcuuacggcgucaaaggcuucuccuuuaaguacgggaacggaguguggauuggccggacaaagagcccuaauucucgcuccggguucgagaugaucugggaucccaacggauggaccgaaacagacagcuccuuuucuguuaaacaggacauuguggccaucaccgauuggagcggcuauuccgggucuuucguccagcacccugagcucaccggccuggacugcauuagacccuguuucuggguggaacuuauccggggacgccccaaggagagcacaaucuggacguccggcagcucuauuuccuuuugcggggucaauagcgauaccgugucuugguccuggccugacggagcggagcugccguucacaaucgauaaauga

SEQ ID NO: 204082 - RNA, 1350 nt, Artificial Sequence
  derived and/or modified sequence opt5 from neuraminidase__InfluenzaA__AEO89102
augaaccccaaucagaagaucauuaccaucggcagcauuugcauggugaucgggauugucucccugaugcuccaaaucggaaacaugaucucuauuuggaucagccacuccauucagacaggcaaucagaaccagguugagccuaucucuaauacgaacuuccugaccgaaaaagccguggcuagcgugauucuugccggcaauuccucucuguguccgaucagaggaugggcgauucauagcaaggacaacuccauccggaucggcagcaaaggggaugucuuugugauucgcgagcccuucaucucuugcucccaccucgaauguagaacauuuuuccugacccaaggagcccuucugaaugacaagcauagcaacggcacaguuaaagaucggucuccucaccgcacccucauguccugccccgugggcgaggcuccuagccccuacaauucuagauuugaauccgucgccuggagcgcuuccgccugucaugacgggacaucuuggcugaccauuggaaucagcggcccugauuccggggcuguggccguucugaaguauaacggaauuaucacggacaccaucaagagcuggcggaauaacauucuccgcacacaggagucugagugcgcgugugugaauggcuccugcuucaccgucaugacagaugggccgagcaacggacaggccucuuacaaaaucuuuaagauggaaaaaggcaaggugauuaaaagcguggagcuggacgcucccaacuaucacuacgaagaguguuccugcuauccugaugccggcgagaucaccugugucugcagagacaauuggcacgggucuaaccggcccuggguuagcuucaaucagaaccuugaauaccaaauuggauauaucugcuccggcguguuuggggauaauccucgccccaacgacggaacgggcagcugugggccggugucucauaauggagcuuacggcgucaagggcuucuccuuuaaguacgggaacggaguguggaucggcagaacaaaaagcccuaauucucgguccggguucgagaugauuugggaucccaacggauggagcgaaaccgacuccucuuuuagcguuaagcaggacaucguggccauuacagauugguccggcuauucugggagcuucguccagcacccugagcugaccggccucgacugcauccgccccuguuucuggguggaacugauuagaggacggcccaaagaguccaccguuuggacaagcgggucuuccaucagcuuuugcggggucaauucugauacgguguccuggagcuggccugacggagcggagcuuccguucaccauugauaaguga

SEQ ID NO: 204083 - RNA, 1350 nt, Artificial Sequence
  derived and/or modified sequence opt5 from neuraminidase__InfluenzaA__AEO89111
augaaccccaaucagaagaucauuaccaucggcagcauuugcauggugaucgggauugucucccugaugcuccaaaucggaaacaucauuucuaucuggguuagccacuccauucagacaggcaaucagcaucaggacgagccuaucagaaacgccaaugugcugacggaaaacgcuguggccucugucacccuugcggggaauagcucccuguguccggugcggggaugggcuguucacucuaaagauaacagcauucgcaucggcuccaagggggacguguucgucauuagagagcccuuuaucagcugcucucaucucgaaugucggacauucuuucugacccaaggagcccuucugaaugauaaacacuccaacggcacagugaaggaccgcagcccucauagaacccucaugucuugccccguuggcgaggccccuucccccuacaauagccgguucgaaucuguggcuugguccgccagcgcuugucacgaugggacauccuggcugaccaucggaauuucuggcccugacaacggggccgucgcggugcugaaauauaauggaaucauuacggauaccaucaagagcuggcgcaacaauauucucagaacacaggaguccgagugcgccugugugaacggcagcugcuuuaccgucaugacagacgggccgucuaacggacaggcuuccuacaagaucuucaaaauggaaaagggcaaaguugucaagagcguggagcugaaugcccccaacuaucacuacgaagaguguucuugcuauccugaugcuggcgagaucaccugugugugccgggacaauuggcaugggagcaaccgccccuggguguccuuuaaucagaaccuugaauaccaaauuggauauaucugcucuggcguuuucggggauaauccuagacccaacgacggaacgggcagcugugauccgguguccccuaauggggccuacggaauuaaaggcuuuagcuucaaguacggcaacggggucuggaucggacggacaaagucuaccaauucccgcagcggcuuugagaugauuugggaccccaacggguggacagaaaccgacucuaauuucuccgugaaacaggauaucguugcgaucaccgacuggagcggauauuccggcucuuuugugcagcacccugagcugacagggcucgauugcauuagacccuguuucugggucgaacugauccggggccgccccaaggagagcacgauuuggaccuccggaucuagcaucuccuucugcggcgugaacagcgacacagucucuugguccuggccugauggggccgagcuuccguuuaccauugacaaauga

SEQ ID NO: 204084 - RNA, 1350 nt, Artificial Sequence
  derived and/or modified sequence opt5 from neuraminidase__InfluenzaA__AEO89120
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuagaaacgcuucuuuccugacggaaaaugccguggcgagcgugacccuugcugggaacuccucucuguguccgguccggggaugggccgugcacagcaaagacaauuccauccgcauuggcagcaagggggauguuuuugugaucagagagcccuucauuucuugcucccaucucgaaugucggacauuuuuccugacccaaggagcccuucugaacgacaaacacagcaauggcacagucaaggaucgcucuccucauagaacccucauguccugccccgugggcgaggcuccuagccccuacaacucucgguuugaauccguugccuggagcgcuuccgccugucacgacgggaucucuuggcugacaaucggaauuagcggcccugauaauggggcgguggccguccugaaauauaacggaaucauuaccgacacgaucaaguccuggcgcaauaacauucucagaacccaggagagcgagugcgcuugugugaauggcucuugcuucacagugaugaccgaugggccguccaacggacaggccagcuacaagaucuuuaaaauggaaaagggcaaagucguuaagucuguggagcugaacgcucccaauuaucacuacgaagaguguagcugcuauccugacgccggcgagaucacaugugugugccgggauaacuggcauggguccaaucgccccugggucucuuucaaccagaaucuugaauaccaaauuggauauaucugcagcggcguguuuggggacaacccuagacccaaugauggaaccggcuccugugggccgguuagcccuaacggagcguacggcauuaaaggcuucucuuuuaaguacgggaauggaguguggaucggccggacgaaguccacaaacagccgcucuggguucgagaugauuugggaccccaauggaugggccgaaaccgauuccaacuuuagcgucaaacaggacaucguggcuaucacagacugguccggcuauucugggagcuucguucagcacccugagcugaccggccucgauugcauuagacccuguuucuggguggaacugauccggggacgccccaaggagggcaccauuuggacauccgggucuagcaucuccuuuugcggagucaauagcgacacggugucuugguccuggccugauggcgccgagcuuccguucaccauugacaaauga

SEQ ID NO: 204085 - RNA, 1350 nt, Artificial Sequence
  derived and/or modified sequence opt5 from neuraminidase__InfluenzaA__AEO89129
augaaccccaaucagaagaucauuaccaucggcagcauuugcauggugaucgggauugucucccugaugcuccaaaucggaaacaucauuucuaucuggguuagccacuccacacagacgggcaaucagcaucaggacgagccuauuagaaacgccaauuuccugaccgaaaacgcuguggccucugugacacuugcggggaauagcucccuguguccgguccggggaugggcugugcacucuaaagauaacagcauccgcguuggcuccaagggggacguguuugucauuagagagcccuucaucagcugcucucaucucgaaugucggaccuuuuuccugacacaaggagcccuucugaaugauaaacacuccaacggcaccgugaaggaccgcagcccucauagaacacucaugucuugccccguuggcgaggccccuucccccuacaauagccgguuugaaucuguggcuugguccgccagcgcuugucacgaugggaccuccuggcugacgauuggaaucucuggcccugacaacggggccgucgcggugcugaaauauaauggaaucauuaccgauacaaucaagagcuggcgcaacaauauucucagaacccaggaguccgagugcgccugugugaacggcagcugcuucacagucaugaccgacgggccgucuaacggacaggcuuccuacaagaucuuuaaaauggaaaagggcaaaguugucaagagcguggagcugaaugcccccaacuaucacuacgaagaguguucuugcuauccugaugcuggcgagauuacgugugugugccgggacaauuggcaugggagcaaccgccccuggguguccuucaaucagaaccuugaauaccaaaucggauauaucugcucuggcguuuuuggggauaauccuagacccaacgacggaacaggcagcugugauccgguguccccuaauggggccuacggaauuaaaggcuucagcuuuaaguacggcaacggggucuggaucggacggaccaagucuacaaauucccgcagcggcuucgagaugauuugggaccccaacggguggaccgaaaccgacucuaauuuuuccgugaaacaggauaucguugcgauuacagacuggagcggauauuccggcucuuucgugcagcacccugagcugacggggcucgauugcaucagacccuguuucugggucgaacugauccggggccgccccaaggagagcaccauuuggacauccggaucuagcaucuccuuuugcggcgugaacagcgacaccgucucuugguccuggccugauggggccgagcuuccguucacaauugacaaauga

SEQ ID NO: 204086 - RNA, 1350 nt, Artificial Sequence
  derived and/or modified sequence opt5 from neuraminidase__InfluenzaA__AEO89138
augaaccccaaucagaagaucauuaccaucggcagcauuugcauggugacagggaucgucucccugaugcuccaaauuggaaacaucaucucuauguggguuagccacuccauucagacgagaaaucagcaucaggccgagccuauccggaacaccaauuuccugacagaaaacgcuguggccucugugacccuuacaggcaauagcucccuguguccgauucgcgggugggcgguccacucuaaagacaacagcaucagaauuggauccaagggcgauguguuuguuauccgggagcccuucauuagcugcucucaucucgaaugucgcaccuuuuuccugacacaaggggcccuucugaaugacaaacacuccaacggaaccgugaaggauagaagcccucaucggacgcucaugucuugccccgucggcgaggcuccuucccccuacaauagccgcuuugaaucuguggccugguccgcuagcgccugucacgacggcaccuccuggcugacaaucgggaucucuggaccugauaacggcgcuguugccgugcugaaauauaaugggauuaucaccgacacaauuaagagcuggagaaacaauauccuccggacccaggaguccgagugcgcgugugucaacggaagcugcuucacggugaugacagauggcccgucuaacgggcaggccuccuacaagauuuuuaaaauggaaaagggaaaaguggucaagagcguugagcugaaugcucccaacuaucacuacgaagaguguucuugcuauccugacgccggcgagaucaucugugugugccgcgauaauuggcauggcagcaacagacccuggguguccuucaaucagaaccuugaauaccaaauuggguauaucugcucuggagucuuuggcgacaauccucggcccaacgaugggaccggaagcuguggcccgguguccccuaauggggcuuacggaauuaaaggcuucagcuuuaaguacggcaacgggguuuggaucggacgcacaaagucuaccaauuccagaagcggcuucgagaugauuugggaccccaacggguggaccggaacagauaaugacuuuucugugaaacaggacaucgucgccaucacggauugguccggcuauagcggguccuucgugcagcacccugaacugaccggccucgacugcauucggcccuguuucuggguugagcugauccgcggaagacccaaggaaucuacaguguggaccagcggcuccucuauuagcuuuugcggggucaacuccgauacagugagcuggucuuggccugacggagcggagcuuccguucaccaucgauaaauga

SEQ ID NO: 204087 - RNA, 1350 nt, Artificial Sequence
  derived and/or modified sequence opt5 from neuraminidase__InfluenzaA__AEO89156
augaaccccaaucagaagaucauuaccaucggcagcauuugcauggugacagggaucgucucccugaugcuccaaauuggaaacaucacgucuauguggguuagccacuccauccagaccagaaaucagcaucaggccgagccuauucggaacacaaauuuccugaccgaaaacgcuguggccucugugacacuugcgggcaauagcucccuguguccgauccgcgggugggcuguccacucuaaagacaacagcauuagaaucggauccaagggcgauguguuuguuauucgggagcccuucaucagcugcucucaucucgaaugucgcaccuuuuuccugacacaaggggcccuucugaaugacaaacacuccaacggaaccgugaaggauagaagcccucaucggacgcucaugucuugccccgucggcgaggccccuucccccuacaauagccgcuuugaaucuguggcuugguccgccagcgcuugucacgacggcaccuccuggcugacaauugggaucucuggaccugauaacggcgccguugcggugcugaaauauaaugggaucauuaccgacacaaucaagagcuggagaaacaauauucuccggacccaggaguccgagugcgccugugucaacggaagcugcuucacggugaugacagauggcccgucuaacgggcaggcuuccuacaagaucuuuaaaauggaaaagggaaaaguggucaagagcguugagcugaaugcccccaacuaucacuacgaagaguguucuugcuauccugacgcuggcgagauuaucugugugugccgcgauaauuggcauggcagcaacagacccuggguguccuucaaucagaaccuugaauaccaaaucggguauauuugcucuggagucuuuggcgacaauccucggcccaacgaugggaccggaagcuguggcccgguguccccuaauggggccuacggaaucaaaggcuucagcuuuaaguacggcaacgggguuuggauuggacgcacaaagucuaccaauuccagaagcggcuucgagaugaucugggaccccaacggguggaccggaacagauucugacuuuuccgugaaacaggacauugucgcgaucacggauuggagcggcuauuccgggucuuucgugcagcacccugaacugaccggccucgacugcauccggcccuguuucuggguugagcugauucgcggaagacccaaggaaagcacaaucuggaccuccggcucuagcauuuccuuuugcggggugaauagcgauacagucucuugguccuggccugacggagccgagcuuccguucaccaucgauaaauga

SEQ ID NO: 204088 - RNA, 1350 nt, Artificial Sequence
  derived and/or modified sequence opt5 from neuraminidase__InfluenzaA__AEO89174
augaaccccaaucagaagaucauuaccaucggcagcauuugcauggugacagggaucgucucccugaugcuccaaauuggaaacaucaucucuauguggguuagccacuccauucagacgagaaaucagcaucaggccgagccuauccggaacaccaauuuccugacagaaaacgcuguggccucugugacccuugcgggcaauagcucccuguguccgauucgcgggugggcuguccacucuaaagacaacagcaucagaauuggauccaagggcgauguguuuguuauccgggagcccuucauuagcugcucucaucucgaaugucgcacauuuuuccugacccaaggggcccuucugaaugacaaacacuccaacggaacagugaaggauagaagcccucaucggacccucaugucuugccccgucggcgaggccccuucccccuacaauagccgcuuugaaucuguggcuugguccgccagcgcuugucacgacggcacguccuggcugaccaucgggaucucuggaccugauaacggcgccguugcggugcugaaauauaaugggauuaucacagacaccauuaagagcuggagaaacaauauccuccggacacaggaguccgagugcgccugugucaacggaagcugcuucaccgugaugacggauggcccgucuaacgggcaggcuuccuacaagauuuuuaaaauggaaaagggaaaaguggucaagagcguugagcugaaugcccccaacuaucacuacgaagaguguucuugcuauccugacgcuggcgagaucaucugugugugccgcgauaauuggcauggcagcaacagacccuggguguccuucaaucagaaccuugaauaccaaauuggguauaucugcucuggagucuuuggcgacaauccucggcccaacgaugggacaggaagcuguggcccgguguccccuaauggggccuacggaauuaaaggcuucagcuuuaaguacggcaacgggguuuggaucggacgcaccaagucuacaaauuccagaagcggcuucgagaugauuugggaccccaacggguggaccggaaccgauucugacuuuuccgugaaacaggacaucgucgcgaucacagauuggagcggcuauuccgggucuuucgugcagcacccugaacugacgggccucgacugcauucggcccuguuucuggguugagcugauccgcggaagacccaaggaaagcaccauuuggacauccggcucuagcaucuccuuuugcggggugaauagcgauaccgucucuugguccuggccugacggagccgagcuuccguucacaauugauaaauga

SEQ ID NO: 204089 - RNA, 1350 nt, Artificial Sequence
  derived and/or modified sequence opt5 from neuraminidase__InfluenzaA__AEO89183
augaaccccaaucagaagaucgugaccauuggcagcaucugcauggucauugggaucguuucccugaugcuccaaauuggaaacaugaucucuaucugggugagccacuccauucagacaggcaaucagcaucagacggagccuaucagaaacaccaauuuccugacagaaaacaccguggccucugucacacuugcugggaauagcucccuguguccgauucggggaugggccgugcacucuaaagacaacagcauccgcauuggcuccaagggggauguuuuugugaucagagagcccuucauuagcugcucucaucucgaaugucggaccuuuuuccugacacaaggagcgcuucugaaugacaaacacuccaacggcaccgucaaggaucgcagcccucauagaacgcucaugucuugccccaucggcgaggcuccuucccccuacaauagccgguuugaaucuguggccugguccgccagcgcuugucacgacgggaccuccuggcugacaaucggaauuucuggcccugauaacggggccguugcugugcugaaauauaauggaaucauuaccgacacaaucaagagcuggcgcaacaauauucucagaacccaggaguccgagugcgccugugucaacggcagcugcuucacggugaugacagaugggccgucuaacggacaggcguccuacaagaucuuuaaaauggaaaagggcaaaguggucaagagcguugagcugaaugcccccaacuaucacuacgaagaguguucuugcuauccugacgcuggcgagaucauuugugugugccgggauaauuggcaugggagcaaccgccccuggguguccuucaaucagaaccuugaauaccaaaucggauauauuugcucuggcgucuuuggggacaauccuagacccaacgauggaaaaggcagcugugggccgguguccccuaauggagccuacggcguuaagggcuucagcuuuaaguacgggaacggaguguggaucggccggaccaaaucuacacacucccgcagcggguucgagaugauuugggaccccaauggauggaccggcaccgauucugaauuuuccaugaagcaggacaucgucgcuaucacagacuggagcggguauuccggcucuuucgugcagcauccugagcugacgggacucgauugcauuagacccuguuucuggguugaacugauccggggccgccccaaagagagcaccauuuggacauccgggucuagcaucuccuuuugcggagugaacagcgacaccgucucuugguccuggccugauggcgccgagcuuccguucacaauugacaaguga

SEQ ID NO: 204090 - RNA, 1350 nt, Artificial Sequence
  derived and/or modified sequence opt5 from neuraminidase__InfluenzaA__AEO89205
augaaccccacccagaagaucauuacaaucggcagcauuugcauggugaucgggauugucucccugaugcuccaaaucggaaauaugaucucuauuuggguuagccacuccauccagacgggcaaccagcaucaggccgagccuauuagaaaugcuucuuuccugaccgaaaacgccguggcgagcgugacacuugcuggaaauuccucucuguguccgguccgggggugggccgugcacagcaaagacaacuccauccgcauuggcagcaagggggauguuuuugugaucagagagcccuucauuucuugcucccaucucgaaugucggaccuuuuuccugacacaaggagcccuucugaaugacaaacacagcaacggcaccgucaaggaucgcucuccucauagaacacucauguccugccccgugggcgaggcuccuagccccuacaauucucgguuugaauccguugccuggagcgcuuccgccugucacgacgggaucucuuggcugaccaucggaauuagcggcccugauaacggggcgguggccguccugaaauauaauggaaucauuacggacaccaucaaguccuggcgcaacaauauucucagaacacaggagagcgagugcgcuugugugaacggcucuugcuucaccgugaugacagaugggccguccaauggacaggccagcuacaagaucuuuaaaauggaaaagggcaaagucguuaagucuguggagcugaacgcucccaacuaucacuacgaagaguguagcugcuauccugacgccggcgagaucaccugugugugccgggauaauuggcauggguccaaccgccccugggucucuuucaaucagaaccuugaauaccaaauuggauauaucugcagcggcguguuuggggacaauccuagacccaacgauggaacgggcuccugugggccgguuagcccuaauggagcguacggcauuaaaggcuucucuuuuaaguacgggaacggaguguggaucggccggacaaaguccaccaauagccgcucuggguucgagaugauuugggaccccaacggaugggccgaaacagauuccaauuuuagcgucaaacaggacaucguggcuaucaccgacugguccggcuauucugggagcuucguucagcacccugagcugaccggccucgauugcauuagacccuguuucuggguggaacugauccggggacgccccaaggagggcacaauuuggacguccgggucuagcaucuccuuuugcggagucaacagcgacaccgugucuugguccuggccugauggcgccgagcuuccguucacaauugacaaauga

SEQ ID NO: 204091 - RNA, 1350 nt, Artificial Sequence
  derived and/or modified sequence opt5 from neuraminidase__InfluenzaA__AEO89215
augaaccccaaucagaagaucauuaccaucggcagcauuugcauggccaucgggauugugucccugaugcuccaaaucggaaacaugaucucuauuugggucagccacuccauccagacaggcaaucagcaucaggcugagccuauuagaaacgccucuuuccugacggaaaaugcgguugcuagcgugacccuugccgggaacuccucucuguguccggugcggggaugggccguccacagcaaagacaauuccauccgcauuggcagcaagggggauguguuuguuaucagagagcccuucauuucuugcucccaucucgaaugucggacauuuuuccugacccaaggagcccuucugaacgacaaacacagcaauggcacagugaaggaucgcucuccucauagaacccucauguccugccccgucggcgaggcuccuagccccuacaacucucgguuugaauccguggcuuggagcgccuccgcgugucacgacgggaucucuuggcugacaaucggaauuagcggcccugauaauggggccguugcugugcugaaauauaacggaaucauuaccgacacgaucaaguccuggcgcaauaacauucucagaacccaggagagcgagugcgccugugucaauggcucuugcuucacagugaugaccgaugggccguccaacggacaggcuagcuacaagaucuuuaaaauggaaaagggcaaaguggucaagucuguugagcugaacgcccccaauuaucacuacgaagaguguagcugcuauccugacgcgggcgagaucacaugugugugccgggauaacuggcauggguccaaucgccccugggugucuuucaaccagaaucuugaauaccaaauuggauauaucugcagcggcgucuuuggggacaacccuagacccaaugauggaaccggcuccugugggccggugagcccuaacggagccuacggcauuaaaggcuucucuuuuaaguacgggaauggaguuuggaucggccggacgaaguccacaaacagccgcucuggguucgagaugauuugggaccccaauggaugggcugaaaccgauuccaacuuuagcgugaaacaggacaucgucgccaucacagacugguccggcuauucugggagcuucgugcagcacccugagcugaccggccucgauugcauuagacccuguuucuggguugaacugauccggggacgccccaaggagggcaccauuuggacauccgggucuagcaucuccuuuugcggagugaauagcgacacggucucuugguccuggccugauggcgcugagcuuccguucaccauugacaaauga

SEQ ID NO: 204092 - RNA, 1350 nt, Artificial Sequence
  derived and/or modified sequence opt5 from neuraminidase__InfluenzaA__AEO89226
augaaccccacccagaagaucauuacaaucggcagcauuugcauggccaucgggauugugucccugaugcuccaaaucggaaauaugaucucuauuugggucagccacuccauccagacgggcaaccagcaucaggcugagccuauuagaaaugccucuuuccugaccgaaaacgcgguugcuagcgugacacuugccggaaauuccucucuguguccggugcgggggugggccguccacagcaaagacaacuccauccgcauuggcagcaagggggauguguuuguuaucagagagcccuucauuucuugcucccaucucgaaugucggaccuuuuuccugacacaaggagcccuucugaaugacaaacacagcaacggcaccgugaaggaucgcucuccucauagaacacucauguccugccccgucggcgaggcuccuagccccuacaauucucgguuugaauccguggcuuggagcgccuccgcgugucacgacgggaucucuuggcugaccaucggaauuagcggcccugauaacggggccguugcugugcugaaauauaauggaaucauuacggacaccaucaaguccuggcgcaacaauauucucagaacacaggagagcgagugcgccugugucaacggcucuugcuucaccgugaugacagaugggccguccaauggacaggcuagcuacaagaucuuuaaaauggaaaagggcaaaguggucaagucuguugagcugaacgcccccaacuaucacuacgaagaguguagcugcuauccugacgcgggcgagaucaccugugugugccgggauaauuggcauggguccaaccgccccugggugucuuucaaucagaaccuugaauaccaaauuggauauaucugcagcggcgucuuuggggacaauccuagacccaacgauggaacgggcuccugugggccggugagcccuaauggagccuacggcauuaaaggcuucucuuuuaaguacgggaacggaguuuggaucggccggacaaaguccaccaauagccgcucuggguucgagaugauuugggaccccaacggaugggcugaaacagauuccaauuuuagcgugaaacaggacaucgucgccaucaccgacugguccggcuauucugggagcuucgugcagcacccugagcugaccggccucgauugcauuagacccuguuucuggguugaacugauccggggacgccccaaggagggcacaauuuggacguccgggucuagcaucuccuuuugcggagugaacagcgacaccgucucuugguccuggccugauggcgcugagcuuccguucacaauugacaaauga

SEQ ID NO: 204093 - RNA, 1350 nt, Artificial Sequence
  derived and/or modified sequence opt5 from neuraminidase__InfluenzaA__AEO89237
augaaccccaaucagaagaucauuaccaucggcagcauuugcauggugaucgggauugucucccugaugcuccaaaucggaaacaucauuucuauguggguuagccacuccauccagacaagaaaucagcaucaggccgagccuauucggaacacgaauuuccugaccgaaaacgcuguggccucugugacacuugcgggcaauagcucccuguguccgauccgcgggugggcuguccacucuaaagacaacagcauuagaaucggauccaagggcgauguguuuguuauucgggagcccuucaucagcugcucucaucucgaaugucgcaccuuuuuccugacacaaggggcccuucugaaugacaaacacuccaacggaaccgugaaggauagaagcccucaucggacacucaugucuugccccgucggcgaggccccuucccccuacaauagccgcuuugaaucuguggcuugguccgccagcgcuugucacgacggcaccuccuggcugacgaucgggauuucuggaccugauaacggcgccguugcggugcugaaauauaaugggaucauuaccgacacaaucaagagcuggagaaacaauauucuccggacccaggaguccgagugcgccugugucaacggaagcugcuucacagugaugaccgauggcccgucuaacgggcaggcuuccuacaagaucuuuaaaauggaaaagggaaaaguggucaagagcguugagcugaaugcccccaacuaucacuacgaagaguguucuugcuauccugacgcuggcgagaucauuugugugugccgcgauaauuggcauggcagcaacagacccuggguguccuucaaucagaaccuugaauaccaaaucggguauauuugcucuggagucuuuggcgacaauccucggcccaacgaugggacgggaagcuguggcccgguguccccuaauggggccuacggaaucaaaggcuucagcuuuaaguacggcaacgggguuuggauuggacgcacaaagucuaccaauuccagaagcggcuucgagaugaucugggaccccaacggguggacaggaaccgauucugacuuuuccgugaaacaggacaucgucgcgauuaccgauuggagcggcuauuccgggucuuucgugcagcacccugaacugacaggccucgacugcauccggcccuguuucuggguugagcugauucgcggaagacccaaggaaagcacgaucuggaccuccggcucuagcauuuccuuuugcggggugaauagcgauacagucucuugguccuggccugacggagccgagcuuccguucaccaucgauaaauga

SEQ ID NO: 204094 - RNA, 1350 nt, Artificial Sequence
  derived and/or modified sequence opt5 from neuraminidase__InfluenzaA__AEO89248
augaaccccaaucagaagaucauuaccaucggcagcauuugcauggugaucgggauugucucccugaugcuccaaaucggaaacaucauuucuaucuggguuagccacuccuuccagacaagagugcagcaucaggccgagccuauucggaauacgaacuuucugaccgaaaaugcuguggccucugucacacuugcgggcaacagcucccuguguccgauccgcgggugggcugugcacucuaaagacaauagcauuagaaucggauccaagggcgauguuuucgugauucgggagcccuuuaucagcugcucucaucucgaaugucgcaccuucuuucugacacaaggggcccuucugaacgacaaacacuccaauggaaccgucaaggauagaagcccucaucggacacucaugucuugccccgugggcgaggccccuucccccuacaacagccgcuucgaaucuguugcuugguccgccagcgcuugucacgacggcaccuccuggcugacgaucgggauuucuggaccugauaauggcgccguggcgguccugaaauauaacgggaucauuaccgacacaaucaagagcuggagaaauaacauucuccggacccaggaguccgagugcgccugugugaauggaagcugcuuuacagugaugaccgauggcccgucuaacgggcaggcuuccuacaagaucuucaaaaugaagaaaggaaaggucguuaaaagcguggaacugaacgcccccaauuaucacuacgaggaauguucuugcuauccugacgcuggcgagaucauuugugugugccgcgauaacuggcauggcagcaauagacccugggucuccuuuaaccagaaucuugaguaccaaaucggguauauuugcucuggaguguucggcgacaacccucggcccaaugaugggacgggaagcuguggcccgguuuccccuaacggggccuacggaaucaagggcuuuagcuucaaguacggcaaugggguguggauuggacgcacaaaaucuaccaacuccagaagcggcuuugaaaugaucugggaccccaauggguggacaggaaccgauucugacuucuccaugaagcaggacaucgucgcgauuaccgauuggagcggcuauuccgggucuuucgugcagcacccugagcugacaggccucgacugcauccggcccuguuuuuggguugaacugauucgcggaagacccaaagagagcacgaucuggaccuccggcucuagcauuuccuucugcggggugaacagcgauacagucucuugguccuggccugacggagccgaacuuccguuuaccaucgauaaguga

SEQ ID NO: 204095 - RNA, 1350 nt, Artificial Sequence
  derived and/or modified sequence opt5 from neuraminidase__InfluenzaA__AEO89270
augaaccccaaucagaagaucauuaccaucggcagcauuugcauggugacagggaucgucucccugaugcuccaaauuggaaacaucacgucuauguggguuagccacuccauccagaccagaaaucagcaucaggccgagccuauucggaacacaaauuuccugaccgaaaacgcuguggccucugugacacuugcgggcaauagcucccuguguccgauccgcgggugggcuguccacucuaaagacaacagcauuagaaucggauccaagggcgauguguuuguuauucgggagcccuucaucagcugcucucaucucgaaugucgcaccuuuuuccugacacaaggggcccuucugaaugacaaacacuccaacggaaccgugaaggauagaagcccucaucggacgcucaugucuugccccgucggcgaggccccuucccccuacaauagccgcuuugaaucuguggcuugguccgccagcgcuugucacgacggcaccuccuggcugacaauugggaucucuggaccugauaacggcgccguugcggugcugaaauauaaugggaucauuaccgacacaaucaagagcuggagaaacaauauucuccggacccaggaguccgagugcgccugugucaacggaagcugcuucacggugaugacagauggcccgucuaacgggcaggcuuccuacaagaucuuuaaaauggaaaagggaaaaguggucaagagcguugagcugaaugcccccaacuaucacuacgaagaguguucuugcuauccugacgcuggcgagauuaucugugugugccgcgauaauuggcauggcagcaacagacccuggguguccuucaaucagaaccuugaauaccaaaucggguauauuugcucuggagucuuuggcgacaauccucggcccaacgaugggaccggaagcuguggcccgguguccccuaauggggccuacggaaucaaaggcuucagcuuuaaguacggcaacgggguuuggauuggacgcacaaagucuaccaauuccagaagcggcuucgagaugaucugggaccccaacggguggaccggaacagauucugacuuuuccgugaaacaggacauugucgcgaucacggauuggagcggcuauuccgggucuuucgugcagcacccugaacugaccggccucgacugcauccggcccuguuucuggguugagcugauucgcggaagacccaaggaaagcacaaucuggaccuccggcucuagcauuuccuuuugcggggugaauagcgauacagucggauggucuuggccugacggcgccgagcuuccguucaccaucgauaaauga

SEQ ID NO: 204096 - RNA, 1350 nt, Artificial Sequence
  derived and/or modified sequence opt5 from neuraminidase__InfluenzaA__AEO89281
augaaccccaaucagaagaucauuaccaucggcagcauuugcaugguggucgggaucguuucccugaugcuccaaauuggaaacaucgugucuaucugggugagccacuccauucagacaggccaucagcagcaagccgagccuaucaaaaauacgaacuuccugaccaagaaugcugucgccucugugacacuugcggggaacagcucccuguguccgauuagaggaugggcuguucacucuaaagacaauagcauccggauuggcuccaagggggauguguuugucauccgcgaacccuucauuagcugcucucaucucgaguguagaaccuuuuuccugacacagggagcccuucugaacgacaaacacuccaauggcaccgugaaggaucggagcccucaucgcacacucaugucuugccccguuggcgaagccccuucccccuacaacagcagauuugagucuguggcuugguccgccagcgcuugucacgacgggaccuccuggcugacgaucggaaucucuggcccugauaauggggccgucgcggugcugaaguauaacggaauuaucaccgacacaauuaaaagcuggcggaauaacacccuccgcacacaggaauccgagugcgccugugugaauggcagcugcuucaccgucaugacggaugggccgucuaacggacaggcuuccuacaagaucuuuaaaauggagaagggcaaaguugucaagagcgccgaacugaacgcucccaauuaucacuacgaggaauguucuugcuauccugacgccggcgagauuaucugugugugcagagauaacuggcaugggagcaaucggcccuggguguccuucaaccaaaaucuugaguaccagaucggauauauuugcucuggcguguuuggggacaacccucgccccaaugauggaacaggcagcugugggccgguuuccccuaacggagcguacggcaucaagggcuucagcuuuaaauacgggaauggaguguggauuggcagaaccaagucuacaaacucccggagcggguucgaaaugaucugggaccccaauggauggaccggcaccgauucuaacuuuuccaugaaacaggacauugucgccaucacagaguggagcggguauuccggcucuuucgugcagcacccugaacugacgggacucgacugcauccgccccuguuucuggguugagcugauuagaggccggcccaaggaaagcaccaucuggacauccgggucuagcauuuccuuuugcggagugaauagcgauaccgucucuugguccuggccugacggcgcugagcuuccguucacaaucgauaaauga

SEQ ID NO: 204097 - RNA, 1350 nt, Artificial Sequence
  derived and/or modified sequence opt5 from neuraminidase__InfluenzaA__AEO89291
augaaccccaaucagaagaucauuaccaucggcagcauuugcaugguggucgggaucguuucccugaugcuccaaauuggaaacaucgugucuaucugggugagccacuccauucagacaggccaucagcagcaagccgagccuaucaaaaauacgaacuuccugaccgaaaaugcugucgccucugugacacuugcggggaacagcucccuguguccgauuagaggaugggcuguucacucuaaggacaauagcauccggauuggcuccaaaggggauguguuugucauccgcgagcccuucauuagcugcucucaucucgaauguagaaccuuuuuccugacacagggagcccuucugaacgacaagcacuccaauggcaccgugaaagaucggagcccucaucgcacacucaugucuugccccguuggcgaggccccuucccccuacaacagcagauuugaaucuguggcuugguccgccagcgcuugucacgacgggaccuccuggcugacgaucggaaucucuggcccugauaauggggccgucgcggugcugaaguauaacggaauuaucaccgacacaauuaagagcuggcggaauaacauccuccgcacccaggaguccgagugcgccugugugaauggcagcugcuucacagucaugaccgaugggccgucuaacggacaggcuuccuacaaaauuuuuaagauggaaaaaggcaagguugugaaaagcgccgagcugaacgcucccaauuaucacuacgaagaguguucuugcuauccugacgccggcgagaucaucugugugugcagagauaacuggcaugggagcaaucggcccugggucuccuucaaccaaaaucuugaauaccagauuggauauaucugcucuggcguguuuggggacaacccucgccccaaugauggaacgggcagcugugggccgguuuccccuaacggagcguacggcauuaagggcuucagcuuuaaguacgggaauggaguguggaucggcagaacaaaaucuaccaacucccggagcggguucgagaugauuugggaccccaauggauggacaggcaccgauucuaacuuuuccaugaagcaggacaucgucgccaucaccgaauggagcggguauuccggcucuuucgugcagcacccugagcugacaggacucgacugcauucgccccuguuucuggguugaacugaucagaggccggcccaaagagagcacgauuuggaccuccgggucuagcaucuccuuuugcggagugaauagcgauacagucucuugguccuggccugacggcgcugagcuuccguucaccauugauaaguga

SEQ ID NO: 204098 - RNA, 1350 nt, Artificial Sequence
  derived and/or modified sequence opt5 from neuraminidase__InfluenzaA__AEO89302
augaaccccaaucagaagaucauuaccaucggcagcauuugcauggugaucgggauugucucccugaugcuccaaaucggaaacaucauuucuaucuggguuagccacuccauucagacaggcaaucagcaucaggacgagccuaucagaaacgccaauuuccugacggaaaacgcuguggccucugugacccuugcggggaauagcucccuguguccgguccggggaugggcugugcacucuaaagauaacagcauucgcaucggcuccaagggggacguuuuugugauuagagagcccuucaucagcugcucucaucucgaaugucggacauuuuuccugacccaaggagcccuucugaaugauaaacacuccaacggcacagucaaggaccgcagcccucauagaacccucaugucuugccccgugggcgaggccccuucccccuacaauagccgguuugaaucuguugcuugguccgccagcgcuugucacgaugggacauccuggcugaccaucggaauuucuggcccugacaacggggccguggcgguccugaaauauaauggaaucauuacggauaccaucaagagcuggcgcaacaauauucucagaacacaggaguccgagugcgccugugugaacggcagcugcuucaccgugaugacagacgggccgucuaacggacaggcuuccuacaagaucuuuaaaauggaaaagggcaaagucguucggagcguggagcugaaugcccccaacuaucacuacgaagaguguucuugcuauccugaugcuggcgagaucaccugugugugccgcgacaauuggcaugggagcaacagacccugggucuccuucaaucagaaccuugaauaccaaauuggauauaucugcucuggcguguuuggggauaauccucggcccaacgacggaacgggcagcugugauccgguuuccccuaauggggccuacggaauuaagggcuucagcuuuaaauacggcaacgggguguggaucggacgcacaaagucuaccaauuccagaagcggcuucgagaugauuugggaccccaacggguggacagaaaccgacucugauuuuuccgucaagcaggacaucguggcgaucaccgauuggagcggauauuccggcucuuucguucagcacccugagcugacagggcucgacugcauucggcccuguuucuggguggaacugauccgcggcagacccaaagagagcacgauuuggaccuccggaucuagcaucuccuuuugcggcgucagcucugauacaguguccuggagcuggccugacggggccgagcuuccguucaccauugauaaguga

SEQ ID NO: 204099 - RNA, 1410 nt, Artificial Sequence; identical to SEQ ID NO: 199081
  derived and/or modified sequence opt5 from neuraminidase__InfluenzaA__AEO99218

SEQ ID NO: 204100 - RNA, 1410 nt, Artificial Sequence
  derived and/or modified sequence opt5 from neuraminidase__InfluenzaA__AEQ49739
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagguuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaagggcuucgagaugauuugggauccuaacggguggaccggaaccgacaauaacuuuuccaucaaacaagacaucgugggcauuaaugaauggucuggguacagcggcuccuucguccagcaucccgagcuuacaggaauggauuguauccgcccuugcuucuggguggaacugauuagaggccggcccaaggagaacacgaucuggaccagcgggucuuccauuagcuuuuguggaguuaauucugacacagugggcugguccuggcccgauggggcugagcucccuuucaccaucgacaaauga

SEQ ID NO: 204101 - RNA, 1410 nt, Artificial Sequence; identical to SEQ ID NO: 203281
  derived and/or modified sequence opt5 from neuraminidase__InfluenzaA__AEQ49740

SEQ ID NO: 204102 - RNA, 1410 nt, Artificial Sequence
  derived and/or modified sequence opt5 from neuraminidase__InfluenzaA__AEQ49741
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggaauggauuguauucgcccuugcuucugggucgaacugaucagaggccggcccaaggagaacacgauuuggaccagcgggucuuccaucagcuuuuguggaguuaauucugacacagugggcugguccuggcccgauggggcugagcucccuuucaccaucgacaaauga

SEQ ID NO: 204103 - RNA, 1410 nt, Artificial Sequence
  derived and/or modified sequence opt5 from neuraminidase__InfluenzaA__AEQ49742
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauucauucuaaggacaauuccaucagaaucgggagcaaaggagauguguuugucauucgggagccguucaucucuuguagcccccucgaaugccgcaccuuuuuccugacacagggcgcccuucugaacgacaagcacuccaauggcaccauuaaagauagaucuccuuaccggacgcucauguccugucccaucggggaggugccuagccccuauaacucccgcuuugaaucuguugccuggagcgcuuccgccugccaugacggaauuaacuggcugaccaucggcaucagcgggccugauaauggagcuguggccguccugaaguacaacggcauuaucacagacaccauuaagucuuggagaaauaacauccuccggacacaagaguccgagugugcgugcgugaaugggagcuguuucaccauuaugacggauggaccgucugacggccaggccagcuauaaaaucuuucgcaucgaaaagggcaaaauugugaaguccgucgagaugaacgcucccaauuaccacuaugaagagugcucuuguuacccugauagcuccgagaucacaugcguuugcagagacaacuggcaugggagcaaucggcccugggugucuuucaaccagaaucuggaauaccagauuggauauaucuguuccggcauuuuuggggauaacccucgccccaaugacaaaaccggaagcugcggcccggugucuuccaacggggccaauggagucaagggcuucagcuuuaaguacggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguauagcggcuccuucgugcagcaccccgagcuuacaggaauggauuguauucgcccuugcuucugggucgaacugaucagaggccggcccaaggagaacacgauuuggaccagcgggucuuccaucagcuuuuguggaguuaauucugacacagugggcugguccuggcccgauggggcugagcucccuuucaccaucgacaaauga

SEQ ID NO: 204104 - RNA, 1410 nt, Artificial Sequence
  derived and/or modified sequence opt5 from neuraminidase__InfluenzaA__AEQ49743
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcacaaaugaauggucuggguacagcggcuccuucgugcagcaucccgagcuuacgggacuggauuguauccgcccuugcuucugggucgaacucauuagaggccggcccaaggagaacaccaucuggacaagcgggucuuccauuagcuuuuguggaguuaauucugacaccgugggcugguccuggcccgauggggcugagcugccuuucacaaucgacaacuga

SEQ ID NO: 204105 - RNA, 1410 nt, Artificial Sequence
  derived and/or modified sequence opt5 from neuraminidase__InfluenzaA__AEQ49744
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuugugaacgacaagcauuccaauggcaccauuaaagauagaucuccuuaucggacgcugauguccugucccaucggggagguuccuagccccuacaacucccgcuuugaaucuguggccuggagcgcuuccgccugccacgacggaauuaacuggcucaccaucggcaucagcgggccugauaauggagcugucgccgugcugaaguauaacggcauuaucacagacaccauuaagucuuggagaaauaacaucuuccggacacaagaguccgagugugcgugcgugaaugggagcuguuuuaccauuaugacggauggaccgucugacggccaggccagcuacaaaaucuuccgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuuuaaccaggaucuggaauaucagauuggauacaucuguuccggcauuuucggggacaauccucgccccaacgauaaaaccggaagcugcggcccggucucuuccaauggggccaacggagugaagggcuuuagcuucaaguauggcaaugggguuuggaucggaagaacaaaauccauuucuagccggaagggcuuugagaugaucugggacccuaacggguggaccggaaccgacaacaauuucuccaucaaacaaaacauugugggcaucaaugaauggucuggguacagcggcuccuucguccagcaucccgagcucacaggacuggauuguauucgcccuugcuuuuggguggaacuuaucagaggccggcccaaggagaacacgauuuggaccagcgggucuuccaucagcuucuguggaguuaauucugacacagugggcugguccuggcccgauggggcugagcugccuuuuaccaucgacaaauga

SEQ ID NO: 204106 - RNA, 1410 nt, Artificial Sequence; identical to SEQ ID NO: 204102
  derived and/or modified sequence opt5 from neuraminidase__InfluenzaA__AEQ49745

SEQ ID NO: 204107 - RNA, 1410 nt, Artificial Sequence; identical to SEQ ID NO: 204102
  derived and/or modified sequence opt5 from neuraminidase__InfluenzaA__AEQ49746

SEQ ID NO: 204108 - RNA, 1410 nt, Artificial Sequence; identical to SEQ ID NO: 204102
  derived and/or modified sequence opt5 from neuraminidase__InfluenzaA__AEQ49747

SEQ ID NO: 204109 - RNA, 1410 nt, Artificial Sequence; identical to SEQ ID NO: 203281
  derived and/or modified sequence opt5 from neuraminidase__InfluenzaA__AEQ49748

SEQ ID NO: 204110 - RNA, 1410 nt, Artificial Sequence; identical to SEQ ID NO: 204102
  derived and/or modified sequence opt5 from neuraminidase__InfluenzaA__AEQ49749

SEQ ID NO: 204111 - RNA, 1410 nt, Artificial Sequence
  derived and/or modified sequence opt5 from neuraminidase__InfluenzaA__AEQ49750
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaaucauuccaacggcaccauuaaggauagaucuccuuaucggacgcucauguccugucccaucggggaggugccuagccccuacaacucccgcuuugaaucuguugccuggagcgcuuccgccugccacgacggaauuaauuggcugaccaucggcaucagcgggccugauaacggagcuguggccguccugaaauauaauggcauuaucacagacaccauuaagucuuggagaaacaauauccuccggacacaagaguccgagugugcgugcgugaacgggagcuguuucaccauuaugacggauggaccgucugacggccaggccagcuacaagaucuuucgcaucgaaaaaggcaagauugugaaauccgucgagaugaaugcucccaacuaucauuacgaagagugcucuuguuacccugauagcuccgagaucacaugcguuugcagagacaauuggcacgggagcaaccggcccugggugucuuucaaucagaaccuggaauaucagauuggauacaucuguuccggcauuuuuggggauaauccucgccccaacgacaagaccggaagcugcggcccggugucuuccaauggggccaacggagucaaaggcuucagcuuuaaguauggcaacgggguguggaucggaagaacaaagaauauuuccucucggaaaggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 204112 - RNA, 1410 nt, Artificial Sequence
  derived and/or modified sequence opt5 from neuraminidase__InfluenzaA__AEQ49751
augaaccccaaucagaagaucauuaccaucggcagcgugugcaugacaauugggauggccaaccugauccuccaaauuggaaauaucaucuccauuuggaucucucacagcuuccagcugggcaaccagucccagauugagacguguaaucaaucugucaucaccuacgaaaacaauacauggguuaaccagaccuaugugaauauuagcaacacaaauuuugcugccgggcaguccguggucucugugaaacuugcgggaaacagcucccugugcccuguuagcggcugggcuaucuacucuaaggacaauuccauuagaaucgggagcaaaggagauguguucgucauccgggagccguuuauuucuuguagcccccucgaaugccgcaccuucuuucugacacagggcgcccuucugaacgacaaucauuccaacggcaccaucaaggauagaucuccuuaucggacgcucauguccugucccauuggggaggugccuagccccuacaacucccgcuucgaaucuguugccuggagcgcuuccgccugccacgacggaaucaauuggcugaccauuggcaucagcgggccugauaacggagcuguggccguccugaaauauaauggcaucauuacagacaccaucaagucuuggagaaacaauauucuccggacacaagaguccgagugugcgugcgugaacgggagcuguuuuaccaucaugacggauggaccgucugacggccaggccagcuacaagauuuuccgcaucgaaaaaggcaagaucgugaaauccgucgagaugaaugcucccaacuaucauuacgaagagugcucuuguuacccugauagcuccgagauuacaugcguuugcagagacaauuggcacgggagcaaccggcccugggugucuuuuaaucagaaccuggaauaucagaucggauacauuuguuccggcaucuucggggauaauccucgccccaacgacaagaccggaagcugcggcccggugucuuccaauggggccaacggagucaaaggcuuuagcuucaaguauggcaacgggguguggauuggaagaacaaaguccaucucuagccggaaaggcuuugagaugauuugggauccuaauggguggaccggaaccgacaacaauuucuccaucaagcaagacaucguuggcauuaacgaauggucuggguacagcggcuccuucgugcagcaucccgagcuuacaggaauggauuguauccgcccuugcuuuugggucgaacugauuagaggccggcccaaagagaauacgaucuggaccagcgggucuuccauuagcuucuguggagugaacucugacacaguuggcugguccuggcccgauggggcugagcucccuuuuaccaucgacaaguga

SEQ ID NO: 204113 - RNA, 1410 nt, Artificial Sequence
  derived and/or modified sequence opt5 from neuraminidase__InfluenzaA__AEQ49752
augaaccccaaucagaagaucauuaccaucggcagcgugugcaugacaauugggauggccaaccugauccuccaaauuggaaauaucaucuccauuuggaucucucacagcauucagcugggcaaccagucccagaucgggacguguaaucaaucugucauuaccuacgagaacaauacauggguuaaccagaccuaugugaauaucagcaacacaaauuucgcugccggacaguccguggucucugugaaacuugcgggcaacagcucccugugcccuguuagcgggugggcuauuuacucuaaggacaauuccaucagaaucggaagcaaaggcgauguguuugucauucgggaaccguucaucucuuguagcccccucgagugccgcaccuuuuuccugacacagggcgcccuucugaacgacaagcauuccaaugggaccauuaaagauagaucuccuuaucggacgcucauguccugucccaucggagaagugccuagccccuacaacucccgcuuugagucuguugccuggagcgcuuccgccugccacgacggcauuaacuggcugaccaucgggaucagcggaccugauaauggcgcuguggccguccugaaguauaacgggauuaucacagacaccauuaagucuuggagaaauaacauccuccggacacaagaauccgagugugcgugcgugaauggaagcuguuucaccauuaugacggauggcccgucugacggccaggccagcuacaaaaucuuucgcaucgagaaggggaaaauugugaaguccgucgaaaugaacgcucccaauuauuacuacgaggaaugcucuuguuauccugauagcuccgagaucacaugcguuugcagagacaacuggcauggaagcaaucggcccugggugucuuucaaccagaaucuggaguaccagauuggcuauaucuguuccgggauuuuuggagauaacccucgccccaaugacaaaaccggcagcugcgggccggugucuuccaacggagccaauggcgucaagggcuucagcuuuaaguacgggaacggaguguggaucggcagaacaaaauccauuucuagccggaagggguucgaaaugaucugggauccuaacggauggaccggcaccgacaauaacuuuuccaucaaacaagacauuguugggaucaaugaguggucuggcuauagcggauccuucgugcagcaccccgaacuuacaggcauggauuguauucgcccuugcuucugggucgagcugaucagagggcggcccaaggaaaacacgauuuggaccagcggaucuuccaucagcuuuuguggcguuaauucugacacaguggggugguccuggcccgauggagcugagcucccuuucaccaucgacaaauga

SEQ ID NO: 204114 - RNA, 1410 nt, Artificial Sequence
  derived and/or modified sequence opt5 from neuraminidase__InfluenzaA__AEQ49753
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggaauggauuguauucgcccuugcuucugggucgaacugaucagaggccggcccaaggagaacacgauuuggaccagcgggucuuccaucagcuuuuguggaguuaauucugacacaguggauugguccuggcccgacggcgcugagcucccuuucaccaucgauaaauga

SEQ ID NO: 204115 - RNA, 1410 nt, Artificial Sequence
  derived and/or modified sequence opt5 from neuraminidase__InfluenzaA__AEQ49754
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggaguuaauucuaacacagugggcugguccuggcccgacggggcugagcugccuuucaccaucgauaaauga

SEQ ID NO: 204116 - RNA, 1410 nt, Artificial Sequence; identical to SEQ ID NO: 204102
  derived and/or modified sequence opt5 from neuraminidase__InfluenzaA__AEQ49755

SEQ ID NO: 204117 - RNA, 1410 nt, Artificial Sequence
  derived and/or modified sequence opt5 from neuraminidase__InfluenzaA__AEQ49756
augaaccccaaucagaagaucauuaccaucggcagcgugugcaugacaauugggauggccaaccugauccuccaaauuggaaauaucaucuccauuuggaucucucacagcauucagcugggcaaccagucccaggucgagacguguaaucaaucuguuaucaccuacgaaaacaauacaugggugaaccagaccuaugugaauauuagcaacacaaauuucgcugccgggcaguccgucgugucuguuaaacuugcgggaaacagcucccugugcccugugagcggcugggcuaucuacucuaaggacaauuccauuagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauaauggagcugucgccgugcugaaguauaacggcaucauuacagacaccaucaagucuuggagaaauaacauucuccggacacaagaguccgagugugcgugcgugaaugggagcuguuucaccaucaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaagggcuucgagaugauuugggauccuaacggguggaccggaaccgacaauaacuuuuccaucaaacaagacaucgugggcauuaaugaauggucuggguacagcggcuccuucguccagcaucccgagcuuacaggacuggauuguauccgcccuugcuucuggguggaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 204118 - RNA, 1410 nt, Artificial Sequence; identical to SEQ ID NO: 204102
  derived and/or modified sequence opt5 from neuraminidase__InfluenzaA__AEQ49757

SEQ ID NO: 204119 - RNA, 1410 nt, Artificial Sequence
  derived and/or modified sequence opt5 from neuraminidase__InfluenzaA__AEQ49758
augaaccccaaucagaagaucauuaccaucggcagcgugugcaugacaauugggauggccaaccugauccuccaaauuggaaauaucaucuccauuuggaucucucacagcauucagcugggcaaccauucccagaucgagacguguaaucagucugucauuaccuacgaaaacaauacauggguuaaccaaaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcacuccaauggcaccauuaaagauagaucuccuuaucggacgcucauguccugucccaucggggaggugccuagccccuacaacucccgcuuugaaucuguugccuggagcgcuuccgccugccaugacggaauuaacuggcugaccaucggcaucagcgggccugauaauggagcuguggccguccugaaguauaacggcauuaucacagacaccauuaagucuuggagaaauaacauccuccggacacaggaguccgagugugcgugcgugaaugggagcuguuucaccauuaugacggauggaccgucugacggccaagccagcuacaaaaucuuucgcaucgaaaagggcaaaauugugaaguccgucgagaugaacgcucccaauuauuacuacgaagagugcucuuguuauccugauagcuccgagaucacaugcguuugcagagacaacuggcacgggagcaaucggcccugggugucuuucaaccagaaucuggaauaccagauuggauauaucuguuccggcauuuuuggggauaacccucgccccaaugacaaaaccggaagcugcggcccggugucuuccaacggggccaauggagucaagggcuucagcuuuaaguacggcaacgggguguggaucggaagaacaaaauccauuucuagccggaagggcuucgagaugaucugggauccuaacgggugggcuggaaccgacaauaacuuuuccaucaaacaggacauuguuggcaucaaugaauggucuggguauagcggcuccuucgugcaacaucccgagcuuaccggacuggauuguauucgcccuugcuucugggucgaacucaucagaggccggcccaaggagaacacaauuuggacgagcgggucuuccaucagcuuuuguggaguuaauucugacaccgugggcugguccuggcccgauggggccgagcugccuuucacaaucgacaaauga

SEQ ID NO: 204120 - RNA, 1410 nt, Artificial Sequence; identical to SEQ ID NO: 204102
  derived and/or modified sequence opt5 from neuraminidase__InfluenzaA__AEQ49759

SEQ ID NO: 204121 - RNA, 1410 nt, Artificial Sequence; identical to SEQ ID NO: 204102
  derived and/or modified sequence opt5 from neuraminidase__InfluenzaA__AEQ49760

SEQ ID NO: 204122 - RNA, 1410 nt, Artificial Sequence
  derived and/or modified sequence opt5 from neuraminidase__InfluenzaA__AEQ49761
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggcuuaaccagaccuauguuaauaucagcaacacaaauuucgcugccgggcaguccguggugucugucaaacuggcgggaaacagcucccucugcccugugagcggcugggcuauuuacucuaaggacaauuccaucagaaucgggagcaaaggagauguuuuugugauucgggagccguucaucucuuguucccccagcgaaugccgcaccuuuuuccugacacagggcgcccuucugaacgacaagcauucuaauggcaccauuaaagauagauccccuuaucggacgcucaugagcugucccaucggggaggucccuucccccuacaacucucgcuuugaaagcguggccugguccgcuagcgccugccacgacggaauuaacuggcugaccaucggcaucucugggccugauaauggagcuguugccgugcugaaguauaacggcauuaucacagacaccauuaaguccuggagaaauaacauccuccggacacaagagagcgagugugcgugcgucaaugggucuuguuucaccauuaugacggauggaccgagcgacggccaggccuccuacaaaaucuuucgcaucgaaaagggcaaaauugugaagucuguggagaugaacgcucccaauuaucauuacgaagagugcagcuguuacccugauuccagcgagaucacaugcgucugcagagacaacuggcacgggucuaaucggcccuggguuuccuucaaccagaaucuggaauaucagauuggauacaucuguagcggcauuuuuggggauaacccucgccccaaugacaaaaccggaucuugcggcccgguguccagcaacggggccaauggagugaagggcuucuccuuuaaguauggcaacggggucuggaucggaagaacaaaaucuauuagcucccggaagggcuucgagaugaucugggauccuaacggguggaccggaaccgacaauaacuuuucuaucaaacaagacauugugggcaucaaugaauggagcggguacuccggcagcuucguucagcaucccgagcuuacaggacuggauuguauucgcccuugcuucuggguggaacucaucagaggccggucuaaggagaacacgauuuggaccuccgggagcucuaucuccuuuuguggagucaauagcgacacagugggcuggucuuggcccgauggggcugagcugcccuucaccaucgacaaauga

SEQ ID NO: 204123 - RNA, 1410 nt, Artificial Sequence
  derived and/or modified sequence opt5 from neuraminidase__InfluenzaA__AEQ49762
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggaucaaccagaccuauguuaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggucccuagccccuacaacucccgcuuugaaucuguggccuggagcgcuuccgccugccacgacggaaucaacuggcugaccaucggcauuagcgggccugauaauggagcuguugccgugcugaaguauaacggcaucauuacagacaccaucaagucuuggagaaauaacauucuccggacacaagaguccgagugugcgugcgucaaugggagcuguuucaucaucaugaccgauggaccgucugacggccaggccagcuacaaaauuuuucgcaucgaaaagggcaaaauugugaaguccguggagaugaacgcucccaauuaucauuacgaagagugcucuuguuacccugauagcuccgagaucacgugcgucugcagagacaacuggcacgggagcaaucggcccuggguuucuuucaaccagaaucuggaauaucagauuggauacaucuguuccggcauuuuuggggauaacccucgccccaaugacaaaacaggaagcugcggcccggugucuuccaacggggccaauggagugaagggcuucagcuuuaaguauggcaacggggucuggaucggaagaaccaaauccaucucuagccggaagggcuucgagaugauuugggauccuaacggguggacaggaaccgacaauaacuuuuccaucaaacaagacauugugggcaucaaugaauggucuggguacagcggcuccuucguucagcaucccgagcuuaccggacuggauuguauucgcccuugcuucuggguggaacucaucagaggccggcccaaggagaacacaaucuggacgagcgggucuuccauuagcuuuuguggagucaauucugacaccgugggcugguccuggcccgauggggcugagcugccuuucacaaucgacaaauga

SEQ ID NO: 204124 - RNA, 1410 nt, Artificial Sequence; identical to SEQ ID NO: 204102
  derived and/or modified sequence opt5 from neuraminidase__InfluenzaA__AEQ49763

SEQ ID NO: 204125 - RNA, 1410 nt, Artificial Sequence; identical to SEQ ID NO: 204102
  derived and/or modified sequence opt5 from neuraminidase__InfluenzaA__AEQ49764

SEQ ID NO: 204126 - RNA, 1410 nt, Artificial Sequence; identical to SEQ ID NO: 204102
  derived and/or modified sequence opt5 from neuraminidase__InfluenzaA__AEQ49765

SEQ ID NO: 204127 - RNA, 1410 nt, Artificial Sequence
  derived and/or modified sequence opt5 from neuraminidase__InfluenzaA__AEQ49766
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuuaccggaaacagcucccugugcccuguuagcggcugggcgauuuacucuaaggacaauuccaucagaaucgggagcaaaggagauguguuugucauucgggagccguucaucucuuguagcccccucgaaugccgcacauuuuuccugacccagggcgcccuucugaacgacaagcauuccaauggcacgauuaaagauagaucuccuuaucggacccucauguccugucccaucggggaggugccuagccccuacaacucccgcuuugaaucuguugcuuggagcgccuccgcuugccacgacggaauuaacuggcugacaaucggcaucagcgggccugauaauggagccguggcuguccugaaguauaacggcauuaucaccgacacaauuaagucuuggagaaauaacauccuccggacccaagaguccgagugugccugcgugaaugggagcuguuucacgauuaugacagauggaccgucugacggccaggcgagcuacaaaaucuuucgcaucgaaaagggcaaaauugugaaguccgucgagaugaacgcccccaauuaucauuacgaagagugcucuuguuacccugauagcuccgagauuaccugcguuugcagagacaacuggcacgggagcaaucggcccugggugucuuucaaccagaaucuggaauaucagaucggauacaucuguuccggcauuuuuggggauaacccucgccccaaugacaaaacaggaagcugcggcccggugucuuccaacggggcuaauggagucaagggcuucagcuuuaaguauggcaacgggguguggaucggaagaaccaaauccauuucuagccggaagggcuucgagaugaucugggauccuaacggguggaccggaacagacaauaacuuuuccaucaaacaagacauuguuggcaucaaugaauggucuggguacagcggcuccuucgugcagcaucccgagcuuacgggacuggauuguauucgcccuugcuucugggucgaacucaucagaggccggcccaaggagaacaccauuuggacaagcgggucuuccaucagcuuuuguggaguuaauucugacaccgugggcugguccuggcccgauggggccgagcugccuuucacaaucgacaaauga

SEQ ID NO: 204128 - RNA, 1410 nt, Artificial Sequence
  derived and/or modified sequence opt5 from neuraminidase__InfluenzaA__AEQ49767
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuuaagaucgaaaaaggcaagauugugaaauccgucgagaugaacgcucccaauuaucauuacgaagagugcucuuguuacccugauagcuccgagaucacaugcguuugccgcgacaacuggcacgggagcaauagacccugggugucuuucaaccagaaucuggaauaucagauuggauacaucuguuccggcauuuuuggggauaacccucggcccaaugacaagaccggaagcugcggcccggugucuuccaacggggccaauggagucaagggcuucagcuauaaauacggcaacgggguguggaucggacgcacaaaguccauuucuagcagaaaaggcuuugagaugaucugggauccuaacggguggaccggaaccgacaauaacuucuccaucaagcaagacauuguuggcaucaaugaauggucuggguauagcggcuccuuugugcagcaucccgagcuuacaggaaugggcuguauucggccuugcuucugggucgaacugauccgcgggagacccaaagagaacacgauuuggaccagcggaucuuccaucagcuucuguggcguuaauucugauacaguggggugguccuggcccgacggagcugagcucccuuuuaccaucgauaaguga

SEQ ID NO: 204129 - RNA, 1410 nt, Artificial Sequence; identical to SEQ ID NO: 203281
  derived and/or modified sequence opt5 from neuraminidase__InfluenzaA__AEQ49768

SEQ ID NO: 204130 - RNA, 1410 nt, Artificial Sequence; identical to SEQ ID NO: 204102
  derived and/or modified sequence opt5 from neuraminidase__InfluenzaA__AEQ49769

SEQ ID NO: 204131 - RNA, 1410 nt, Artificial Sequence
  derived and/or modified sequence opt5 from neuraminidase__InfluenzaA__AEQ49770
augaaccccaaucagaagaucauuaccaucggcagcgugugcaugacaauugggauggccaaccugauccuccaaauuggaaauaucaucuccgucuggauuucucacagcauccagcugggcaaccagaaucagacggagaccuguaaccaauccguuauuacauacgaaaauaacaccugggugaaucagacauaugugaacaucucuaauaccaacuucgcugccgggcagagcgucguguccguuaaacuugcgggaaauucuagccugugcccuguguccggcugggcuauuuacagcaaggacaacucuaucagaauuggguccaaaggagaugucuuugugauccgggagccguucaucagcuguucuccccucgaaugccgcacauuuuuccugacccagggcgcccuucugaaugacaagcauuccaacggcacgauuaaagauagaagcccuuaucggacccucaugucuugucccaucggggagguuccuucccccuacaacagccgcuuugaauccguggccuggucugcuagcgccugccacgacggaauuaauuggcugacaaucggcauuuccgggccugauaacggagcugucgccgugcugaaguauaauggcaucaucaccgacacaauuaagagcuggagaaacaauauccuccggacccaagagucugagugugcgugcgugaacggguccuguuucacggucaugacagauggaccgagcgacggccaggccucuuacaaaauuuuucgcaucgaaaagggcaaaauuguuaagagcguggagaugaaugcucccaacuaucauuacgaagagugcuccuguuacccugauucuagcgagauuaccugcgugugcagagacaauuggcacggguccaaccggcccugggucagcuucaaucagaaccuggaauaucgcaucggauacaucuguucuggcaucuuuggggauaauccuagacccaacgacaaaacaggauccugcggcccggugagcucuaauggggccaacggaguuaagggcuucuccuuuaaguauggcaacgggguguggauuggacggaccaaaagcaucuccucucgcaauggcuucgagaugauuugggauccuaacggguggaccggaacagacaauaacuuuagcaucaagcaggacauuaucggcaucaaugaaugguccggguacucuggcagcuucguccaacaucccgagcuuacgggacuggauuguauuagaccuugcuucuggguggaacucauccggggccgccccaaagagaacaccauuuggacauccgggagcucuaucuccuuuuguggaguuaauagcgacaccgugggcuggucuuggcccgauggggcugagcugccuuucacagucgacaaguga

SEQ ID NO: 204132 - RNA, 1410 nt, Artificial Sequence; identical to SEQ ID NO: 204115
  derived and/or modified sequence opt5 from neuraminidase__InfluenzaA__AEQ49771

SEQ ID NO: 204133 - RNA, 1410 nt, Artificial Sequence; identical to SEQ ID NO: 203281
  derived and/or modified sequence opt5 from neuraminidase__InfluenzaA__AEQ49772

SEQ ID NO: 204134 - RNA, 1410 nt, Artificial Sequence
  derived and/or modified sequence opt5 from neuraminidase__InfluenzaA__AEQ49773
augaaccccaaucagaagaucauuaccaucggcagcauuugcaugacaaucgggauggccaaccugauucuccaaaucggaaauaucauuuccaucuggauuucucacagcauccagcugggcaaccagucccagauugagacguguaaucaaucugugaucaccuacgaaaacaauacaugggucaaccagaccuauguuaauauuagcaacacaaauuucgcugccgggcaguccguggugucugucaaacuugcgggaaacagcucccugugcccugugagcggcugggcuaucuacucuaaggacaauuccaucagaauugggagcaaaggagauguuuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggucccuagccccuacaacucccgcuuugaaucuguggccuggagcgcuuccgccugccacgacggaaucaacuggcugaccaucggcauuagcgggccugauaauggagcuguugccgugcugaaguauaacggcaucauuacagacaccaucaagucuuggagaaauaacauucuccggacacaagaguccgagugugcgugcgucaaugggagcuguuucaccaucaugacggauggaccgucugacggccaggccagcuacaaaaucuuucgcauugaaaagggcaaaaucgugaaguccguggagaugaacgcucccaauuaucauuacgaagagugcucuuguuacccugauagcuccgagauuacaugcgucugcagagacaacuggcacgggagcaaucggcccuggguuucuuucaaccagaaucuggaauaucagaucggauacauuuguuccggcaucuuuggggauaacccucgccccaaugacaaaaccggaagcugcggcccggugucuuccaacggggccaauggagugaagggcuucagcuuuaaguauggcaacggggucuggauuggaagaacaaaauccaucucuagccggaagggcuucgagaugaucugggauccuaacggguggaccggaaccgacaauaacuuuuccauuaaacaagacaucgugggcauuaaugaauggucuggguacagcggcuccuucguucagcaucccgagcuuacaggacuggauuguauccgcccuugcuucuggguggaacucauuagaggccggcccaaggagaacacgaucuggaccagcgggucuuccaucagcuuuuguggagucaauucuaacacagugggcugguccuggcccgacggggcugagcugccuuucaccauugauaaauga

SEQ ID NO: 204135 - RNA, 1410 nt, Artificial Sequence
  derived and/or modified sequence opt5 from neuraminidase__InfluenzaA__AEQ49774
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaauauaacacauggguuaaucagaccuacaucaacauuagcaauacaaacuucgcugccgggcaguccguggugucugucaaacuugugggaaauagcucccugugcccuguuagcggcugggcgaucuauucuaaggacaacuccaucagaauugggagcaaaggagauguguuugucauccgggagccguucauuucuuguagcccccucgaaugccgcaccuuuuuccugacacagggcgcccuucugaaugacaagcauuccaacggcaccaucaaagauagaucuccuuaccggacgcucauguccugucccauuggggaggugccuagccccuauaauucccgcuuugaaucuguugcuuggagcgccuccgcuugccacgacggaaucaacuggcugaccaucggcauuagcgggccugauaacggagccguggcuguccugaaguacaauggcaucauuacagacaccaucaagucuuggagaaacaauauucuccggacacaagaguccgagugugccugcgugaacgggagcuguuucaccaucaugacggauggaccgucugacggccaggcgagcuauaaaaucuuucgcauugaaaagggcaaaaucgugaaguccgucgagaugaaugcccccaacuaccauuacgaagagugcucuuguuauccugauagcuccgagauuacaugcguuugcagagacaauuggcacgggagcaaccggcccugggugucuuucaaucagaaccuggaauaccagaucggauauauuuguuccggcaucuuuggggauaauccucgccccaacgacaaaaccggaagcugcggcccggugucuuccaauggggcuaacggagucaagggcuucagcuuuaaguacggcaaugggguguggauuggaagaacaaaauccaucucuagccggaagggcuaugagaugaucugggauccuaacggguggaccggaaccgacaacaauuucuccauuaaacaagacaucguuggcauuaacgaauggucuggguacagcggcuccuuugugcagcaucccgagcuuacaggaauggauuguauccgcccuugcuucugggucgaacugauuagaggccggcccaaggagaauacgaucuggaccagcgggucuuccaucagcuucuguggagugaacucugacacaguuggcugguccuggcccgauggggccgagcucccuuuuaccauugacaaauga

SEQ ID NO: 204136 - RNA, 1410 nt, Artificial Sequence; identical to SEQ ID NO: 203281
  derived and/or modified sequence opt5 from neuraminidase__InfluenzaA__AEQ49775

SEQ ID NO: 204137 - RNA, 1410 nt, Artificial Sequence
  derived and/or modified sequence opt5 from neuraminidase__InfluenzaA__AEQ49776
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguucccccagcgaaugccgcaccuuuuuccucacacagggcgcccugcuuaacgacaagcauucuaauggcaccauuaaagauagauccccuuaucggacgcugaugagcugucccaucggggaggugccuucccccuacaacucucgcuuugaaagcguugccugguccgcuagcgccugccacgacggaauuaacuggcucaccaucggcaucucugggccugauaauggagcuguggccguccugaaguauaacggcauuaucacagacaccauuaaguccuggagaaauaacauccugcggacacaagagagcgagugugcgugcgugaaugggucuuguuucaccauuaugacggauggaccgagcgacggccaggccuccuacaaaaucuuucgcaucgaaaagggcaaaauugugaagucugucgagaugaacgcucccaauuaucauuacgaagagugcagcuguuacccugauuccagcgagaucacaugcguuugcagagacaacuggcacgggucuaaucggcccuggguguccuucaaccagaaucucgaauaucagauuggauacaucuguagcggcauuuuuggggauaacccucgccccaaugacaaaaccggaucuugcggcccgguguccagcaacggggccaauggagucaagggcuucuccuuuaaguauggcaacgggguguggaucggaagaacaaaaucuauuagcucccggaagggcuucgagaugaucugggauccuaacggguggaccggaaccgacaauaacuuuucuaucaaacaagacauuguuggcaucaaugaauggagcggguacuccggcagcuucgugcagcaucccgagcugacaggacuugauuguauucgcccuugcuucugggucgaacugaucagaggccggcccacggagaacaccauuuggacaucuggguccagcaucucuuuuuguggaguuaauuccgacaccgugggcuggagcuggcccgauggggcugagcucccuuucacaaucgacaaguga

SEQ ID NO: 204138 - RNA, 1410 nt, Artificial Sequence; identical to SEQ ID NO: 204102
  derived and/or modified sequence opt5 from neuraminidase__InfluenzaA__AEQ49777

SEQ ID NO: 204139 - RNA, 1410 nt, Artificial Sequence
  derived and/or modified sequence opt5 from neuraminidase__InfluenzaA__AEQ49778
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggaucaaccagaccuauguuaauauuagcaacacaaauuucgcugccgugcaguccguggucucugugaaacuugcggggaacagcacccugugcccuguuuccggaugggcuaucuacagcaaggacaauucuaucagaauuggcuccaaaggggauguguuugucauccgggagccguucauuagcuguucuccccucgaaugccgcacauuuuuccugacccagggagcccuucugaacgacaagcauuccaauggcacgaucaaagauagaagcccuuaucggacccucaugucuugucccauuggcgaggugccuucccccuacaacagccgcuuugaauccguugccuggucugcuagcgccugccacgacgggaucaacuggcugacaaucggaauuuccggcccugauaauggggcuguggccguccugaaguauaacggaaucauuaccgacacaaucaagagcuggagaaauaacauucuccggacccaagagucugagugugcgugcgugaauggcuccuguuucacgaucaugacagaugggccgagcgacggacaggccucuuacaaaaucuuucgcauugaaaagggcaaaaucgucaagagcguggagaugaacgcucccaauuaucauuacgaagagugcuccuguuacccugauucuagcgagauuaccugcguuugcagagacaacuggcacggcuccaaucggcccugggugagcuucaaccagaaucuggaauaucagaucggguacauuuguucuggaaucuuuggcgauaacccucgccccaaugacaaaacaggguccugcggaccggugagcucuaacggcgccaauggggucaagggauucuccuuuaaguauggcaacggcguguggauugggagaaccaaaagcaucuccucucggaagggauucgagaugaucugggauccuaacggcuggaccgggacagacaauaacuuuagcauuaaacaagacaucguuggaauuaaugaaugguccggcuacucugggagcuucgugcagcaucccgagcuuacgggccuggauuguauccgcccuugcuucugggucgaacucauuagaggacggcccaaggagaacaccaucuggacauccggcagcucuaucuccuuuuguggggugaauagcgacaccguuggauggucuuggcccgauggcgcugagcugccuuucacaauugacaaauga

SEQ ID NO: 204140 - RNA, 1410 nt, Artificial Sequence
  derived and/or modified sequence opt5 from neuraminidase__InfluenzaA__AEQ49779
augaaccccaaucagaagaucauuaccaucggcagcgugugcaugacaauugggauggccaaccugauccuccaaauuggaaauaucaucuccauuuggaucucucacagcauucagcugggcaaccagaaucagacggagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucgcaucggauacaucuguucuggcauuuuuggggauaauccuagacccaacgacaaaacaggauccugcggcccggucagcucuaauggggccaacggagugaagggcuucuccuuuaaguauggcaacgggguuuggaucggacggaccaaaagcauuuccucucgcaauggcuucgagaugaucugggauccuaacggguggaccggaacagacaauaacuuuagcauuaagcaggacaucaucggcauuaaugaaugguccggguacucuggcagcuucgugcaacaucccgagcuuacgggacuggauuguaucagaccuugcuucugggucgaacucauucggggccgccccaaagagaacaccaucuggacauccgggagcucuauuuccuuuuguggagugaauagcgacaccguuggcuggucuuggcccgauggggcugagcugccuuucacaguggacaaguga

SEQ ID NO: 204141 - RNA, 1410 nt, Artificial Sequence; identical to SEQ ID NO: 203281
  derived and/or modified sequence opt5 from neuraminidase__InfluenzaA__AEQ49780

SEQ ID NO: 204142 - RNA, 1410 nt, Artificial Sequence; identical to SEQ ID NO: 203281
  derived and/or modified sequence opt5 from neuraminidase__InfluenzaA__AEQ49781

SEQ ID NO: 204143 - RNA, 1410 nt, Artificial Sequence; identical to SEQ ID NO: 204102
  derived and/or modified sequence opt5 from neuraminidase__InfluenzaA__AEQ49782

SEQ ID NO: 204144 - RNA, 1410 nt, Artificial Sequence
  derived and/or modified sequence opt5 from neuraminidase__InfluenzaA__AEQ49783
augaaccccaaucagaagaucauuaccaucggcagcgccugcaugacaauugggauggcuaaccugauccuccaaauuggaaauaucaucuccauuuggaucucucacagcauucagcugggcaaccagucccagaucgagacguguaaucaaucugugauuaccuacgaaaacaauacaugggucaaccagaccuauguuaauaucagcaacacaaauuucgccgcggggcaguccguggugucugucaaacuugcuggaaacagcucccugugcccugugagcggcugggccauuuacucuaaggacaauuccaucagaaucgggagcaaaggagauguuuuugugauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggucccuagccccuacaacucccgcuuugaaucuguggcuuggagcgccuccgcuugccacgacggaauuaacuggcugaccaucggcaucagcgggccugauaauggagccguugcggugcugaaguauaacggcauuaucacagacaccauuaagucuuggagaaauaacauccuccggacacaagaguccgagugugccugcgucaaugggagcuguuucaccauuaugacggauggaccgucugacggccaggcuagcuacaaaaucuuucgcaucgaaaagggcaaaauugugaaguccguggagaugaacgcccccaauuaucauuacgaagagugcucuuguuacccugauagcuccgagaucacaugcgucugcagagacaacuggcacgggagcaaucggcccuggguuucuuucaaccagaaucuggaauaucagauuggauacaucuguuccggcauuuuuggggauaacccucgccccaaugacaaaaccggaagcugcggcccggugucuuccaacggggcuaauggagugaagggcuucagcuuuaaguauggcaacggggucuggaucggaagaacaaaauccauuucuagccggaagggcuucgagaugaucugggauccuaacggguggaccggaaccgacaauaacuuuuccaucaaacaagacauugugggcaucaaugaauggucuggguacagcggcuccuucguucagcaucccgagcuuacaggacuggauuguauucgcccuugcuucuggguggaacucaucagaggccggcccaaggagaacacgauuuggaccagcgggucuuccaucagcuuuuguggagucaauucugacacagugggcugguccuggcccgauggggccgagcugccuuucaccaucgacaaauga

SEQ ID NO: 204145 - RNA, 1410 nt, Artificial Sequence
  derived and/or modified sequence opt5 from neuraminidase__InfluenzaA__AEQ49785
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaugaaagaucacucuaucguuuccagcuacguguguucuggacuugucggcgacacgccccggaagaacgacagcuccucuagcucccauugcuucgauccgaaugacgaggaaggcgggcacggagugaaaggcugggccuuugaugacgggaacgauguuuggaugggacgcaccauuagcgagaagucuagacugggcuaugagacauucaaagugaucgaagggugguccaauccuaagagcaaacuccagaucaaccggcaggucauuguggaccgcggagauagaucuggcuacuccggcaucuuuagcgucgaggggaaguccuguauuaaucggugcuucuauguggaacugaucagaggaucuaaggaggaaaccgagguucuguggaccagcaacuccauuguggucuucuguggcacaucugggaccuacggaacaggcagcuggcccgacggggcugauaucaaucucaugccuauuuga

SEQ ID NO: 204146 - RNA, 1410 nt, Artificial Sequence; identical to SEQ ID NO: 204145
  derived and/or modified sequence opt5 from neuraminidase__InfluenzaA__AEQ49786

SEQ ID NO: 204147 - RNA, 1410 nt, Artificial Sequence; identical to SEQ ID NO: 204145
  derived and/or modified sequence opt5 from neuraminidase__InfluenzaA__AEQ49788

SEQ ID NO: 204148 - RNA, 1410 nt, Artificial Sequence; identical to SEQ ID NO: 204145
  derived and/or modified sequence opt5 from neuraminidase__InfluenzaA__AEQ49789

SEQ ID NO: 204149 - RNA, 1410 nt, Artificial Sequence
  derived and/or modified sequence opt5 from neuraminidase__InfluenzaA__AEQ49790
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucggggccgcacgccguacagaacacuccugaugaacgaacugggggugcccuuucaccucggaaccaagcaggucugcauugccugguccucuagcuccugucaugauggcaaagccuggcugcacgugugcaucacaggcgacgauaagaaugcuaccgccagcuucauuuauaacgggcggcuuguugacucuguggucuccuggagcaaagagauccugcgcacccaggaaucugagugugugugcauuaauggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuacccuagauaccccggggugcggugugucugccgcgauaacuggaagggaagcaacagaccuaucguggacauuaauaucaaagaucacucuauuguuuccagcuauguguguucuggccuugucggcgacacgccccggaagaacgacagcuccucuagcucccauugccuggauccgaauaacgaggaagggggacacggcgugaaagggugggccuucgacgauggaaaugacguuuggaugggccgcaccaucaacgagacaagcagacucggguacgagaccuuuaaggugaucgaaggauggucuaauccuaaauccaagcugcagauuaaccggcaggucaucguggaucgcggcaauagaagcggcuauucugggauuuucuccgucgagggaaaaagcuguaucaaccggugcuuuuacguggaacugauuagaggccgcaaggaggaaaccgagguucucuggacauccaauucuaucguggucuucugugggaccagcggaacauauggcacgggguccuggcccgacggcgcugaucugaaccuuaugccuauuuga

SEQ ID NO: 204150 - RNA, 1410 nt, Artificial Sequence
  derived and/or modified sequence opt5 from neuraminidase__InfluenzaA__AEQ49791
augaaccccaaucagaagaucauuaccaucggcagcgugucccugacaauuucuacgaucugcuucuuuaugcaaauugccauccucaucaccacagucacccugcacuucaaacaguacgaguuuuauccuccgcccaacaaucagguuaugcuuugugaaccuacaauuaucgagagaaacauuaccgaaaucguguaccugacaaauaccacgauugagaaggaaaucugccccaaacucgcugaguaucggaacuggagcaagccucagugugacauuaccggguucgcccccuuuuccaaagauaauucuauccgccugagcgcgggaggcgacaucugggugacaagagagccuuacgucuccugcgauccggacaaguguuaucaauucgcucuugggcagggaaccacacugaacaaugugcauucuaacaauaccguucggaaccgcacgcccuacagaacacuccugaugaaugaacugggcgugccuuuucaccucgggaccaagcaggucugcauugccuggagcuccagcucuugucaugauggaaaagccuggcugcacgugugcaucacaggcgacgauaagaacgcuaccgccuccuucauuuauaauggccggcuuguugacagcguggucucuugguccaaagagauccugcgcacccaggaaagcgagugugugugcauuaacgggacauguacgguggucaugaccgauggaucugcuuccggcaaggccgacacaaaaauccucuuuaucgaggaagggaagauuguucauaccagcacacuguccggaucugcgcaacacguggaggaaugcagcugcuaccccagauacccuggcgugcggugugucugccgcgauaacuggaagggguccaauagacccaucguggacauuaacaucaaagaucacagcauuguuucuuccuauguguguagcggacuugucggcgacaccccgcggaagaaugacucuagcuccucuagccauugccuggauccuaacaaugaggaaggcgggcacggagugaaaggcugggccuucgacgaugggaacgacguuuggaugggacgcacgaucaaugagacauccagacucggcuacgagaccuuuaaggugaucgaaggguggagcaaccccaaaucuaagcugcagauuaaucggcaggucaucguggaucgcggaaacagauccggcuauagcggcauuuucucugucgaggggaaauccuguaucaaucggugcuuuuacguggaacugauuagaggacgcaaggaggaaaccgagguucucuggacaagcaacuccaucguggucuucuguggcaccucugggacauauggaacgggcagcuggccugacggggcugaucugaaucuuaugcccauuuga

SEQ ID NO: 204151 - RNA, 1410 nt, Artificial Sequence; identical to SEQ ID NO: 204145
  derived and/or modified sequence opt5 from neuraminidase__InfluenzaA__AEQ49792

SEQ ID NO: 204152 - RNA, 1410 nt, Artificial Sequence; identical to SEQ ID NO: 204145
  derived and/or modified sequence opt5 from neuraminidase__InfluenzaA__AEQ49793

SEQ ID NO: 204153 - RNA, 1410 nt, Artificial Sequence; identical to SEQ ID NO: 204145
  derived and/or modified sequence opt5 from neuraminidase__InfluenzaA__AEQ49794

SEQ ID NO: 204154 - RNA, 1410 nt, Artificial Sequence; identical to SEQ ID NO: 204145
  derived and/or modified sequence opt5 from neuraminidase__InfluenzaA__AEQ49795

SEQ ID NO: 204155 - RNA, 1410 nt, Artificial Sequence
  derived and/or modified sequence opt5 from neuraminidase__InfluenzaA__AEQ49796
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucggggccgcacgccguauagaacacuccugaugaaugaacugggggugcccuuucaccucggaaccaagcaggucugcauugccugguccucuagcuccugucaugauggcaaagccuggcugcacgugugcaucacaggcgacgauaagaacgcuaccgccagcuucauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuauccuagauaccccggggugcggugugucugccgcgauaacuggaagggaagcaauagaccuaucguggacauuaacaucaaagaucacucuauuguuuccagcuacguguguucuggccuugucggcgacacgccccggaagaaugacagcuccucuagcucccauugccuggauccgaacaaugaggaagggggacacggcgugaaagggugggccuucgacgauggaaacgacguuuggaugggccgcaccaucaaugagacaagcagacucggguaugagaccuuuaaggugaucgaaggauggucuaacccuaaauccaagcugcagauuaaucggcaggucaucguggauaaaggcaaccgcagcggcuacucugggauuuucuccgucgagggaaagagcuguaucaauagaugcuuuuauguggaacugauucggggcagaaaggaggaaaccgagguucucuggacauccaacucuaucguggucuucugugggaccagcggaacauacggcacgggguccuggcccgacggcgcugaucugaaucuuaugccuauuuga

SEQ ID NO: 204156 - RNA, 1410 nt, Artificial Sequence; identical to SEQ ID NO: 204145
  derived and/or modified sequence opt5 from neuraminidase__InfluenzaA__AEQ49797

SEQ ID NO: 204157 - RNA, 1410 nt, Artificial Sequence; identical to SEQ ID NO: 204145
  derived and/or modified sequence opt5 from neuraminidase__InfluenzaA__AEQ49798

SEQ ID NO: 204158 - RNA, 1410 nt, Artificial Sequence; identical to SEQ ID NO: 204145
  derived and/or modified sequence opt5 from neuraminidase__InfluenzaA__AEQ49799

SEQ ID NO: 204159 - RNA, 1410 nt, Artificial Sequence; identical to SEQ ID NO: 204145
  derived and/or modified sequence opt5 from neuraminidase__InfluenzaA__AEQ49800

SEQ ID NO: 204160 - RNA, 1410 nt, Artificial Sequence; identical to SEQ ID NO: 204145
  derived and/or modified sequence opt5 from neuraminidase__InfluenzaA__AEQ49801

SEQ ID NO: 204161 - RNA, 1410 nt, Artificial Sequence; identical to SEQ ID NO: 204145
  derived and/or modified sequence opt5 from neuraminidase__InfluenzaA__AEQ49802

SEQ ID NO: 204162 - RNA, 1410 nt, Artificial Sequence
  derived and/or modified sequence opt5 from neuraminidase__InfluenzaA__AEQ49803
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaucaaagaucacucuauuguuuccagcuacguguguucuggacuugucggcgacacgccccggaagaacgacagcaccuccucuagccauugccuggauccgaauaacgaggaaggcgggcacggagugaaaggcugggccuucgacgaugggaaugacguuuggaugggacgcacaaucuccgagaccagcagacucggcuaugagaccuuuaaggugaucgaaggguggucuaacccuaaauccaagcugcagauuaaucggcaggucaucguggauaaaggaaaccgcagcggcuacucuggcauuuucuccgucgaggggaagucuuguaucaauagaugcuuuuauguggaacugauucggggaagaaaggaggaaacagagguucucuggaccuccaacucuaucguggucuucuguggcacaagcgggacguacggaaccggcuccuggcccgacggggcugaucugaaucuuaugacaauuuga

SEQ ID NO: 204163 - RNA, 1410 nt, Artificial Sequence
  derived and/or modified sequence opt5 from neuraminidase__InfluenzaA__AEQ49804
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagacauccuucgcacccaggagucugaaugugugugcauuaacgggacauguacgguggucaugaccgauggauccgcuagcggcaaggccgacacaaaaauccuguuuaucgaggaggggaagauuguucauaccuccacacucucuggaagcgcgcaacacguggaagagugcuccugcuaucccagauacccuggcgugcggugugucugccgcgauaacuggaaggggagcaauagacccaucguggacauuaacaucaaagaccacucuauuguuuccagcuacguguguucuggacuggucggcgauaccccgcggaagaaugacagcuccucuagcucccauugccuugauccuaacaaugaagagggcgggcacggagugaaaggcugggccuucgacgaugggaacgacguuuggaugggacgcacgaucaaugaaacaagcagacugggcuaugagaccuuuaaggugaucgagggguggucuaaccccaaauccaagcuccagauuaaucggcaggucaucguggaucgcggaaacagaagcggcuacucuggcauuuucuccgucgaagggaaaagcuguaucaaucggugcuuuuauguggagcugauuagaggacgcaaggaagagaccgaaguucuguggacauccaacucuaucguggucuucuguggcaccagcgggacauacggaacgggcuccuggccugacggggcugaucucaaucugaugcccauuuga

SEQ ID NO: 204164 - RNA, 1410 nt, Artificial Sequence
  derived and/or modified sequence opt5 from neuraminidase__InfluenzaA__AEQ49805
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucggaaucgcacgcccuauagaacacugcucaugaacgaacugggcgugccuuuucaccuggggaccaagcaggucugcauugccugguccucuagcuccugucaugauggaaaagccuggcuccacgugugcaucacaggcgacgauaagaaugcuaccgccagcuucauuuacaacggccggcugguugacucuguggucuccuggagcaaagauauccuucgcacccaggagucugaaugugugugcauuaacgggacauguacgguggucaugaccgacggauccgcuagcggcaaggccgauacaaaaauccuguuuaucgaggaggggaagauuguucauaccuccacacucucuggaagcgcgcaacacguggaagagugcuccugcuaucccagauacccuggcgugcggugugucugccgcgacaauuggaaggggagcaacagacccaucguggauauuaauaucaaagaccacucuauuguuuccagcuacguguguucuggacuggucggcgacaccccgcggaagaacgauagcuccucuagcucccauugccuugacccuaauaacgaagagggcgggcacggagugaaaggcugggccuucgaugacgggaaugauguuuggaugggacgcacgaucaacgaaacaagcagacugggcuaugagaccuuuaaggugaucgagggguggucuaaucccaaauccaagcuccagauuaaccggcaggucaucguggaccgcggaaauagaagcggcuacucuggcauuuucuccgucgaagggaaaagcuguaucaaccggugcuuuuauguggagcugauuagaggacgcaaggaagagaccgaaguucuguggacauccaauucuaucguggucuucuguggcaccagcgggacauacggaacgggcuccuggccugauggggcugaccucaaccugaugcccauuuga

SEQ ID NO: 204165 - RNA, 1410 nt, Artificial Sequence
  derived and/or modified sequence opt5 from neuraminidase__InfluenzaA__AEQ49806
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuucuuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuucuccucuagccauugccuggacccgaacaaugaggaaggcgggcacggagugaaaggcugggccuuugaugacgggaacgauguuuggaugggacgcaccaucaaugagacauccagacucggcuaugagaccuucaaggugaucgaaggguggagcaacccuaaaucuaagcugcagauuaaucggcaggucaucguggaccgcggaaacagauccggcuacagcggcauuuuuagcgucgaggggaaauccuguaucaaucggugcuucuauguggaacugauuagaggacgcaaggaggaaaccgagguucucuggacaagcaacuccaucguggucuucuguggcaccucugggacauacggaacgggcagcuggcccgauggggcugaccugaaucuuaugccuauuuga

SEQ ID NO: 204166 - RNA, 1410 nt, Artificial Sequence; identical to SEQ ID NO: 202542
  derived and/or modified sequence opt5 from neuraminidase__InfluenzaA__AEQ49807

SEQ ID NO: 204167 - RNA, 1410 nt, Artificial Sequence
  derived and/or modified sequence opt5 from neuraminidase__InfluenzaA__AEQ49809
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaagggcugggccuucgaugacgggaacgauguuuggaugggacggacgaucaaugagacaagccgccucggcuaugagaccuuuaaagugaucgaaggguggucuaacccuaaguccaaacugcagauuaauagacaggucaucguggaccggggaaaccgcagcggcuacucuggcauuuucuccgucgaggggaaaagcuguaucaauagaugcuuuuauguggaacugauucggggaagaaaggaggaaaccgagguucucuggacauccaacucuaucguggucuucuguggcaccagcgggacauacggaacgggcuccuggcccgauggggcugaccugaaucuuaugccuauuuga

SEQ ID NO: 204168 - RNA, 1410 nt, Artificial Sequence; identical to SEQ ID NO: 204167
  derived and/or modified sequence opt5 from neuraminidase__InfluenzaA__AEQ49811

SEQ ID NO: 204169 - RNA, 1410 nt, Artificial Sequence; identical to SEQ ID NO: 202542
  derived and/or modified sequence opt5 from neuraminidase__InfluenzaA__AEQ49812

SEQ ID NO: 204170 - RNA, 1410 nt, Artificial Sequence; identical to SEQ ID NO: 202542
  derived and/or modified sequence opt5 from neuraminidase__InfluenzaA__AEQ49813

SEQ ID NO: 204171 - RNA, 1410 nt, Artificial Sequence; identical to SEQ ID NO: 202542
  derived and/or modified sequence opt5 from neuraminidase__InfluenzaA__AEQ49815

SEQ ID NO: 204172 - RNA, 1410 nt, Artificial Sequence
  derived and/or modified sequence opt5 from neuraminidase__InfluenzaA__AEQ49816
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuguugaggaagggaagaucgugcauaccuccacacugucuggaagcgcgcaacacguggaggaaugcuccugcuauccuagauaccccggcguccggugugugugccgcgauaauuggaaggggagcaacagaccuauuguugacaucaauaugaaagaucacucuauuguguccagcuacgucuguucuggacuugugggcgacacgccccggaagaacgacagcuccucuagcucccauugcuucgauccgaaugacgaggaaggcgggcacggaguuaaaggcugggccuuugaugacgggaacgauguguggaugggacgcaccaucagcgagaagucuagacugggcuaugagacauucaaagucauugaagggugguccaauccuaagagcaaacuccagaucaaccgccaggugaucgucgaccggggaaauagaucuggcuacuccggcauuuuuagcguggaggggaaguccuguaucaaccggugcuucuauguugaacugauuagaggacgcaaggaggaaaccgaggugcuguggaccucuaauagcaucgucguguucuguggcacauccgggaccuacggaacaggcucuuggcccgauggggcugacauuaaccucaugccuaucuga

SEQ ID NO: 204173 - RNA, 1410 nt, Artificial Sequence; identical to SEQ ID NO: 203907
  derived and/or modified sequence opt5 from neuraminidase__InfluenzaA__AEQ49820

SEQ ID NO: 204174 - RNA, 1410 nt, Artificial Sequence; identical to SEQ ID NO: 203907
  derived and/or modified sequence opt5 from neuraminidase__InfluenzaA__AEQ49821

SEQ ID NO: 204175 - RNA, 1410 nt, Artificial Sequence; identical to SEQ ID NO: 204145
  derived and/or modified sequence opt5 from neuraminidase__InfluenzaA__AEQ49822

SEQ ID NO: 204176 - RNA, 1410 nt, Artificial Sequence; identical to SEQ ID NO: 204145
  derived and/or modified sequence opt5 from neuraminidase__InfluenzaA__AEQ49823

SEQ ID NO: 204177 - RNA, 1410 nt, Artificial Sequence; identical to SEQ ID NO: 204145
  derived and/or modified sequence opt5 from neuraminidase__InfluenzaA__AEQ49824

SEQ ID NO: 204178 - RNA, 1410 nt, Artificial Sequence; identical to SEQ ID NO: 204145
  derived and/or modified sequence opt5 from neuraminidase__InfluenzaA__AEQ49825

SEQ ID NO: 204179 - RNA, 1410 nt, Artificial Sequence; identical to SEQ ID NO: 204145
  derived and/or modified sequence opt5 from neuraminidase__InfluenzaA__AEQ49826

SEQ ID NO: 204180 - RNA, 1410 nt, Artificial Sequence; identical to SEQ ID NO: 204145
  derived and/or modified sequence opt5 from neuraminidase__InfluenzaA__AEQ49827

SEQ ID NO: 204181 - RNA, 1410 nt, Artificial Sequence; identical to SEQ ID NO: 204145
  derived and/or modified sequence opt5 from neuraminidase__InfluenzaA__AEQ49828

SEQ ID NO: 204182 - RNA, 1410 nt, Artificial Sequence
  derived and/or modified sequence opt5 from neuraminidase__InfluenzaA__AEQ49829
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcucucggcaaggccgacacaaaaauccuguuuaucgaggaagggaagauuguucauaccagcacacuuuccggaucugcgcaacacguggaggaaugcagcugcuauccuagauaccccggcgugcggugugucugccgcgauaauuggaagggguccaacagaccuaucguggacauuaauaugaaagaucacagcaucguuucuuccuacguguguagcggacuggucggcgacacgccccggaagaacgacucuagcuccucuagccauugcuucgauccgaaugacgaggaaggcgggcacggagugaaaggcugggccuuugaugacgggaacgauguuuggaugggacgcaccauuuccgagaagucuagacucggcuaugagacauucaaagugaucgaaggguggucuaauccuaaguccaaacugcagaucaaccggcaggucauuguggaccgcggagauagaagcggcuacucuggcaucuuuuccgucgagggaaagagcuguauuaaucggugcuucuauguggaacugaucagaggguccaaggaggaaaccgagguucucuggaccucuaacagcauuguggucuucuguggcacauccgggaccuacggaacaggcucuuggcccgacggggcugauaucaaucugaugccuauuuga

SEQ ID NO: 204183 - RNA, 1410 nt, Artificial Sequence; identical to SEQ ID NO: 204145
  derived and/or modified sequence opt5 from neuraminidase__InfluenzaA__AEQ49830

SEQ ID NO: 204184 - RNA, 1410 nt, Artificial Sequence; identical to SEQ ID NO: 204145
  derived and/or modified sequence opt5 from neuraminidase__InfluenzaA__AEQ49831

SEQ ID NO: 204185 - RNA, 1410 nt, Artificial Sequence
  derived and/or modified sequence opt5 from neuraminidase__InfluenzaA__AEQ49832
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaugaaagaucacucuaucguuuccagcuacguguguucuggacuugucggcgacacgccccggaagaacgacagcuccucuagcucccauugcuucgauccgaaugacgaggaaggcgggcacggagugaaaggcugggccuuugaugacgggaacgauguuuggaugggacgcaccauuagcgagaagucuagacugggcuaugagacauucaaaguggucgaagggugguccaauccuaagagcaaacuccagaucaaccgccaggugaucgucgaccggggagauagaucuggcuacuccggcauuuuuagcguggaggggaaguccuguaucaaucggugcuucuauguugaacugauuagaggaucuaaggaggaaaccgaggugcuguggaccagcaacuccaucgucguguucuguggcacaucugggaccuacggaacaggcagcuggcccgacggggcugauauuaaucucaugccuaucuga

SEQ ID NO: 204186 - RNA, 1410 nt, Artificial Sequence
  derived and/or modified sequence opt5 from neuraminidase__InfluenzaA__AEQ49833
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucaaugagacaagccgccucggcuaugagaccuuuaaagugaucgaaggguggucuaacccuaaguccaaacugcagauuagcagacaggucaucguggaccggggaaaucgcucuggcuacuccggcauuuucagcgucgaggggaaguccuguaucaacagaugcuuuuauguggaacugauucggggaagaaaggaggaaaccgagguucucuggacaucuaauagcaucguggucuucuguggcaccuccgggacauacggaacgggcucuuggcccgauggggcugaccugaaccuuaugccuauuuga

SEQ ID NO: 204187 - RNA, 1410 nt, Artificial Sequence
  derived and/or modified sequence opt5 from neuraminidase__InfluenzaA__AEQ49835
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauggccugguccucuagcuccugucaugauggaaaagccuggcugcacgugugcauuacaggcgacgauaagaaugcuaccgccagcuucaucuacaacggccggcuuguugacucuguggucuccuggagcaaagagauucugcgcacccaggaaucugagugugugugcaucaacgggacauguacgguggucaugaccgauggauccgcuagcggcaaggccgacacaaaaauucucuuuaucgaggaagggaagaucguucauaccuccacacugucuggaagcgcgcaacacguggaggaaugcuccugcuauccuagauaccccggcgugcggugugucugccgcgauaauuggaaggggagcaacagaccuauuguggacaucaauaugaaagaucacucuauuguuuccagcuacguguguucuggacuugucggcgacacgccccggaagaacgacagcuccucuagcucccauugcuucgauccgaaugacgaggaaggcgggcacggagugaaaggcugggccuuugaugacgggaacgauguuuggaugggacgcaccaucagcgagaagucuagacugggcuaugagacauucaaagugauugaagggugguccaauccuaagagcaaacuccagaucaaccggcaggucaucguggaccgcggaaauagaucuggcuacuccggcauuuuuagcgucgaggggaaguccuguaucaaccggugcuucuauguggaacugauuagaggacgcaaggaggaaaccgagguucuguggaccucuaauagcaucguggucuucuguggcacauccgggaccuacggaacaggcucuuggcccgauggggcugacauuaaccucaugccuaucuga

SEQ ID NO: 204188 - RNA, 1410 nt, Artificial Sequence; identical to SEQ ID NO: 204187
  derived and/or modified sequence opt5 from neuraminidase__InfluenzaA__AEQ49836

SEQ ID NO: 204189 - RNA, 1410 nt, Artificial Sequence; identical to SEQ ID NO: 204187
  derived and/or modified sequence opt5 from neuraminidase__InfluenzaA__AEQ49838

SEQ ID NO: 204190 - RNA, 1410 nt, Artificial Sequence; identical to SEQ ID NO: 204187
  derived and/or modified sequence opt5 from neuraminidase__InfluenzaA__AEQ49839

SEQ ID NO: 204191 - RNA, 1410 nt, Artificial Sequence
  derived and/or modified sequence opt5 from neuraminidase__InfluenzaA__AEQ49840
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauggccugguccucuagcuccugucaugauggaaaagccuggcugcacgugugcauuacaggcgacgauaagaaugcuaccgccagcuucaucuacaacggccggcuuguugacucuguggucuccuggagcaaagagauucugcgcacccaggaaucugagugugugugcaucaacgggacauguacgguggucaugaccgauggauccgcuagcggcaaggccgacacaaaaauucucuuuaucgaggaagggaagaucguucauaccuccacacugucuggaagcgcgcaacacguggaggaaugcuccugcuauccuagauaccccggcgugcggugugucugccgcgauaauuggaaggggagcaacagaccuauuguggacaucaauaugaaagaucacucuauuguuuccagcuacguguguucuggacuugucggcgacacgccccggaagaacgacagcuccucuagcucccauugcuucgauccgaaugacgaggaaggcgggcacggagugaaaggcugggccuuugaugacgggaacgauguuuggaugggacgcaccaucagcgagaagucuagacugggcuaugagacauucaaagugauugaagggugguccaaucauaagagcaaacuccagaucaaccggcaggucaucguggaccgcggaaauagaucuggcuacuccggcauuuuuagcgucgaggggaaguccuguaucaaccggugcuucuauguggaacugauuagaggacgcaaggaggaaaccgagguucuguggaccucuaauagcaucguggucuucuguggcacauccgggaccuacggaacaggcucuuggccugauggggcugacauuaaccucaugcccaucuga

SEQ ID NO: 204192 - RNA, 1410 nt, Artificial Sequence; identical to SEQ ID NO: 204187
  derived and/or modified sequence opt5 from neuraminidase__InfluenzaA__AEQ49841

SEQ ID NO: 204193 - RNA, 1410 nt, Artificial Sequence; identical to SEQ ID NO: 204187
  derived and/or modified sequence opt5 from neuraminidase__InfluenzaA__AEQ49842

SEQ ID NO: 204194 - RNA, 1410 nt, Artificial Sequence; identical to SEQ ID NO: 204187
  derived and/or modified sequence opt5 from neuraminidase__InfluenzaA__AEQ49843

SEQ ID NO: 204195 - RNA, 1410 nt, Artificial Sequence; identical to SEQ ID NO: 204145
  derived and/or modified sequence opt5 from neuraminidase__InfluenzaA__AEQ49844

SEQ ID NO: 204196 - RNA, 1410 nt, Artificial Sequence
  derived and/or modified sequence opt5 from neuraminidase__InfluenzaA__AEQ49845
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagcgggaaaucugcccuaagcucgcugaguaccgcaauugguccaaaccccagugugacauuaccggguucgccccuuuuucuaaggauaacagcaucagacuguccgcgggaggcgacaucugggugacacgggagcccuaugucucuugcgauccuaauaaauguuaccaauucgcucuugggcagggaaccacacugaacaaugugcauagcaacaauaccguucgcgacagaacgccguaucggacacuccugaugaacgaacugggcgugcccuuucaccucgggaccaagcaggucugcauggccugguccucuagcuccugucaugauggaaaggccuggcugcacgugugcauuacaggcgacgauaaaaaugcuaccgccagcuucaucuacaacggccgccuuguugacucuguggucuccuggagcaaggagauucugagaacccaggaaucugagugugugugcaucaacgggacauguacgguggucaugaccgauggauccgcuagcggcaaagccgacacaaagauucucuuuaucgaggaagggaaaaucguucauaccuccacacugucuggaagcgcgcaacacguggaggaaugcuccugcuauccucgguaccccggcgugcgcugugucugcagagauaauuggaaggggagcaaccggccuauuguggacaucaauaugaaggaucacucuauuguuuccagcuacguguguucuggacuugucggcgacacgccccgcaaaaacgacagcuccucuagcucccauugcuucgauccgaaugacgaggaaggcgggcacggagugaagggcugggccuuugaugacgggaacgauguuuggaugggaagaaccaucagcgagaaaucucggcugggcuaugagacauucaaggugauugaagggugguccaauccuaaaagcaagcuccagaucaaccgccaggucaucguggacagaggaaaucggucuggcuacuccggcauuuuuagcgucgaggggaaauccuguaucaacagaugcuucuauguggaacugauucgcggacggaaggaggaaaccgagguucuguggaccucuaauagcaucguggucuucuguggcacauccgggaccuacggaacaggcucuuggcccgauggggcugacauuaaccucaugccuaucuga

SEQ ID NO: 204197 - RNA, 1410 nt, Artificial Sequence
  derived and/or modified sequence opt5 from neuraminidase__InfluenzaA__AEQ49846
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauggccugguccucuagcuccugucaugauggaaaagccuggcugcacgugugcauuacaggcgacgauaagaaugcuaccgccagcuucaucuacaacggccggcuuguugacucuguggucuccuggagcaaagagauucugcgcacccaggaaucugagugugugugcaucaacgggacauguacgguggucaugaccgauggauccgcuagcggcaaggccgacacaaaaauucucuuuaucgaggaagggaagaucguucauaccuccacacugucuggaagcgcgcaacacguggaggaaugcuccugcuauccuagauaccccggcgugcggugugucugccgcgauaauuggaaggggagcaacagaccuauuguggacaucaaucuuaaagaucacucuauuguuuccagcuacguguguucuggacuggucggcgacacgccccggaagaacgacagcuccucuagcucccauugcuucgauccgaaugacgaggaaggcgggcacggagugaaaggcugggccuuugaugacgggaacgauguuuggaugggacgcaccaucagcgagaagucuagacucggcuaugagacauucaaagugauugaagggugguccaauccuaagagcaaacugcagaucaaccggcaggucaucguggaccgcggaaauagaucuggcuacuccggcauuuuuagcgucgaggggaaguccuguaucaaccggugcuucuauguggaacugauuagaggacgcaaggaggaaaccgagguucucuggaccucuaauagcaucguggucuucuguggcacauccgggaccuacggaacaggcucuuggcccgauggggcugacauuaaccugaugccuaucuga

SEQ ID NO: 204198 - RNA, 1410 nt, Artificial Sequence
  derived and/or modified sequence opt5 from neuraminidase__InfluenzaA__AEQ49850
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaugaaagaucacucuaucguuuccagcuacguguguucuggacuugucggcgacacgccccggaagaacgacagcuccucuagcucccauugcuucgauccgaaugacgaggaaggcgggcacggagugaaaggcugggccuuugaugacgggaacgauguuuggaugggacgcaccauuagcgagaagucuagacugggcuaugagacauucaaagugaucgaagggugguccaauccuaagagcaaacuccagaucaaccggcaggucauuguggaccgcggagauagaucuggcuacuccggcaucuuuagcgucgaggggaaguccuguauuaaucggugcuucuauguggaacugaucagaggaucuaaggaggaaaccgagguucuguggaccagcaacuccauuguggucuucuguggcacaucugggaccuacggaacaggcagcuggcccgacggggcugauaucaaaauuaugccuaucuga

SEQ ID NO: 204199 - RNA, 1410 nt, Artificial Sequence
  derived and/or modified sequence opt5 from neuraminidase__InfluenzaA__AEQ49851
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuauggagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcaucgccugguccucuagcuccugucaugacggaaaagccuggcugcacgugugcauuacaggcgaugacaagaacgcuaccgccagcuucaucuacaauggcaaacuuguugauucuguggucuccuggagcaaggagauucugcggacccaggaaucugagugugugugcaucaacgggacauguacgguggucaugaccgacggauccgcuagcggcaaagccgauacaaagauucucuuuaucgaggaagggaagaucguucauaccuccacacugucuggaagcgcgcaacacguggaggaaugcuccugcuauccucgcuaccccggcgugagaugugucugccgggacaacuggaaagggagcaaucgcccuauuguggauaucaacauuaaggaccacucuaucguuuccagcuacguguguucuggacuugucggcgacacccccagaaagaaugauagcuccucuagcucccauugccuggacccgaacaaugaggaaggcgggcacggagugaagggcugggccuucgaugacgggaacgauguuuggaugggacggacgauuaaugagacaagccgccucggcuaugagaccuuuaaagugaucgaaggguggucuaacccuaaguccaaacugcagaucaauagacaggucauuguggaccggggaaaccgcagcggcuacucuggcaucuucuccgucgaggggaaaagcuguauuaauagaugcuuuuauguggaacugauccggggaagaaaggaggaaaccgagguucucuggacauccaacucuauuguggucuucuguggcaccagcgggacauacggaacgggcuccuggcccgauggggcugaccugaaucuuaugccuaucuga

SEQ ID NO: 204200 - RNA, 1410 nt, Artificial Sequence; identical to SEQ ID NO: 204167
  derived and/or modified sequence opt5 from neuraminidase__InfluenzaA__AEQ49852

SEQ ID NO: 204201 - RNA, 1410 nt, Artificial Sequence; identical to SEQ ID NO: 204145
  derived and/or modified sequence opt5 from neuraminidase__InfluenzaA__AEQ49969

SEQ ID NO: 204202 - RNA, 1410 nt, Artificial Sequence; identical to SEQ ID NO: 204167
  derived and/or modified sequence opt5 from neuraminidase__InfluenzaA__AEQ49970

SEQ ID NO: 204203 - RNA, 1410 nt, Artificial Sequence
  derived and/or modified sequence opt5 from neuraminidase__InfluenzaA__AEQ54954
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagacaucucgccucggcuaugagaccuuuaaagugaucgaagggugguccaauccuaagagcaaacugcagauuaacagacaggucaucguggaccggggaaaucgcucuggcuacuccggcauuuucagcgucgaggggaaguccuguaucaacagaugcuuuuauguggaacugauucggggaagaaaggaggaaaccgagguucucuggacaucuaauagcaucguggucuucuguggcaccuccgggacauacggaacgggcucuuggcccgauggggcugaccugaaccuuaugccuauuuga

SEQ ID NO: 204204 - RNA, 1410 nt, Artificial Sequence; identical to SEQ ID NO: 199623
  derived and/or modified sequence opt5 from neuraminidase__InfluenzaA__AER08645

SEQ ID NO: 204205 - RNA, 1410 nt, Artificial Sequence
  derived and/or modified sequence opt5 from neuraminidase__InfluenzaA__AER08649
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagcugguucauaccuccacacuuucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuggucggcgacacgccccggaagaaugauagcuccucuagcucccauugccucgacccgaacaaugaggaaggcgggcacggagugaaaggcugggccuucgaugacgggaacgauguuuggaugggacgcaccauuagcgagaagucuagacugggcuaugagacauuuaaagugaucgaagggugguccaauccuaagagcaaacugcagaucaaccggcaggucauuguggaccgcggaaauagaucuggcuacuccggcaucuucagcgucgaggggaaguccuguauuaaccggugcuuuuauguggaacucaucagaggacgcaaggaggaaaccgagguucuguggaccucuaauagcauuguggucuucuguggcacauccgggaccuacggaacaggcucuuggcccgauggggcugacaucaaccuuaugccuauuuga

SEQ ID NO: 204206 - RNA, 1410 nt, Artificial Sequence
  derived and/or modified sequence opt5 from neuraminidase__InfluenzaA__AER08657
augaaccccaaucagaagaucauuaccaucggcagcgugucccugacaauuucuacggucugcuucuuuaugcaaaucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaaugugcccuaaacucgcugaguaccggaauugguccaagccccagugugacauuaccggguucgccccuuuuucuaaagauaacagcauccgccuguccgcgggaggcgacauuugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcaucacaggcgaugacaagaacgcuaccgccagcuucauuuacaauggccggcuuguggauucugucguguccuggagcaaagagauccugcgcacccaggaaucugagugugugugcauuaacgggacauguacggucguuaugaccgacggauccgcuagcggcaaggccgauacaaaaauccucuuuauugaggaagggaagaucgugcauaccuccacacugucuggaagcgcgcaacacguggaggaaugcuccugcuauccuagauaccccggcguccggugugugugccgcgacaacuggaaggggagcaauagaccuaucguugauauuaacaucaaagaccacucuauuguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccaucagcgagaagucuagacucggcuaugagacauuuaaagucauugaagggugguccaauccuaagagcaaacugcagaucaaccgccaggugaucgucgaccggggaaauagaucuggcuacuccggcauuuucagcguggaggggaaguccuguaucaaccggugcuuuuauguugaacugauuagaggacgcaaggaggaaaccgaggugcucuggaccucuaauagcaucgucguguucuguggcacauccgggaccuacggaacaggcucuuggcccgauggggcugacauuaaccugaugccuaucuga

SEQ ID NO: 204207 - RNA, 1410 nt, Artificial Sequence; identical to SEQ ID NO: 199623
  derived and/or modified sequence opt5 from neuraminidase__InfluenzaA__AER08659

SEQ ID NO: 204208 - RNA, 1410 nt, Artificial Sequence
  derived and/or modified sequence opt5 from neuraminidase__InfluenzaA__AER08661
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgaucacggggugaaaggaugggccuucgacgauggcaacgacguuuggauggggcgcaccaucaaugagacaagcagacucggauaugagaccuuuaaggugaucgaaggcuggucuaacccuaaauccaagcugcagauuaaucggcaggucaucguggaucgcgggaacagaagcggauacucuggcauuuucuccgucgagggcaaaagcuguaucaaucggugcuuuuauguggaacugauuagagggcgcaaggaggaaaccgagguucucuggacauccaacucuaucguggucuucuguggaaccagcggcacauacgggacgggauccuggcccgacggcgcugaucugaaucuuaugccuauuuga

SEQ ID NO: 204209 - RNA, 1410 nt, Artificial Sequence; identical to SEQ ID NO: 202542
  derived and/or modified sequence opt5 from neuraminidase__InfluenzaA__AER08663

SEQ ID NO: 204210 - RNA, 1410 nt, Artificial Sequence; identical to SEQ ID NO: 202542
  derived and/or modified sequence opt5 from neuraminidase__InfluenzaA__AER08665

SEQ ID NO: 204211 - RNA, 1410 nt, Artificial Sequence
  derived and/or modified sequence opt5 from neuraminidase__InfluenzaA__AER08669
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuacccucgcugaguaccggaauugguccaaaccccagugugacauuacaggguucgccccuuuuucuaaggauaacagcauccgccuguccgcgggaggcgacaucugggugaccagagagcccuaugucucuugcgauccugacaaauguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcauugccugguccucuagcuccugucaugacggaaaggccuggcugcacgugugcaucaccggcgaugacaaaaacgcuaccgccagcuucauuuacaauggccggcuuguugauucuguggucuccuggagcaaggagauccugcgcacacaggaaucugagugugugugcauuaacgggacguguaccguggucaugacagacggauccgcuagcggcaaagccgauaccaagauccucuuuaucgaggaagggaaaauuguucauacauccacccugucuggaagcgcgcaacacguggaggaaugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaggaaggcgggcacggagugaagggcugggccuucgaugacgggaacgauguuuggaugggacgcacaaucagcgagaccucuagacucggcuaugagaccuuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaagaggaaacagagguucucuggaccucuaauagcaucguggucuucuguggcacauccgggacguacggaaccggcucuuggcccgauggggcugaccugaaccuuaugccuauuuga

SEQ ID NO: 204212 - RNA, 1410 nt, Artificial Sequence
  derived and/or modified sequence opt5 from neuraminidase__InfluenzaA__AER08671
augaaccccaaucagaagaucauuaccaucggcagcgugucccugacaauuucuacgaucugcuucuuuaugcaaauugccauccucaucaccacagucacccugcacuucaaacaguacggguuuaacagcccuccgaauaaccagguuaugcuuugugagcccacaauuaucgaaagaaauauuaccgagaucguguaucugacaaacaccacgauugaaaaggagaucugcccuacccucgcugaauaccggaauugguccaaaccccagugugacauuacaggauucgccccuuuuucuaaggauaacagcauccgccuguccgcgggcggggacaucugggugaccagagagcccuaugucucuugcgauccugacaaauguuaccaauucgcucuuggacagggcacaacccugaauaacgugcauagcaauaacacgguucgggaucgcacaccguauagaacccuccugaugaaugagcugggggugcccuuucaccucggaacaaagcaggucugcauugccugguccucuagcuccugucaugacggcaaggccuggcugcacgugugcaucaccggcgaugacaaaaacgcuaccgccagcuucauuuacaaugggcggcuuguugauucuguggucuccuggagcaaggaaauccugcgcacacaggagucugaaugugugugcauuaacggaacguguaccguggucaugacagacggcuccgcuagcgggaaagccgauaccaagauccucuuuaucgaggagggaaaaauuguucauacauccacccugucuggcagcgcgcaacacguggaagagugcuccugcuauccuagauaccccggggugcggugugucugccgcgacaacuggaagggaagcaauagaccuaucguggauauuaacaucaaggaccacucuauuguuuccagcuacguguguucuggccuugucggcgacacgccccggaaaaaugauagcuccucuagcucccauugccuggacccgaacaaugaagaagggggacacggcgugaaggggugggccuucgaugacggaaacgauguuuggaugggccgcacaaucaaugagaccagcagacucggguaugagaccuuuaaagugaucgagggauggucuaacccuaaguccaaacugcagauuaaucggcaggucaucguggaccgcggcaacagaagcggcuacucugggauuuucuccgucgaaggaaagagcuguaucaaucggugcuuuuauguggagcugauuagaggccgcaaagaagagacagaaguucucuggaccuccaacucuaucguggucuucugugggacaagcggaacguacggcaccggguccuggcccgauggcgcugaccugaaucuuaugccuauuuga

SEQ ID NO: 204213 - RNA, 1410 nt, Artificial Sequence; identical to SEQ ID NO: 202542
  derived and/or modified sequence opt5 from neuraminidase__InfluenzaA__AER08673

SEQ ID NO: 204214 - RNA, 1410 nt, Artificial Sequence; identical to SEQ ID NO: 202542
  derived and/or modified sequence opt5 from neuraminidase__InfluenzaA__AER08675

SEQ ID NO: 204215 - RNA, 1410 nt, Artificial Sequence; identical to SEQ ID NO: 202542
  derived and/or modified sequence opt5 from neuraminidase__InfluenzaA__AER08677

SEQ ID NO: 204216 - RNA, 1410 nt, Artificial Sequence; identical to SEQ ID NO: 202542
  derived and/or modified sequence opt5 from neuraminidase__InfluenzaA__AER08679

SEQ ID NO: 204217 - RNA, 1410 nt, Artificial Sequence
  derived and/or modified sequence opt5 from neuraminidase__InfluenzaA__AER08681
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacgaugaggaaggcgggcacggagugaaaggcugggccuucgacgaugggaaugacguuuggaugggacgcaccaucaacgagacaagcagacucggcuaugagaccuuuaaggugaucgaaggguggucuaauccuaaauccaagcugcagauuaaccggcaggucaucguggauaaaggaaaucgcagcggcuacucuggcauuuucuccgucgaggggaagucuuguaucaacagaugcuuuuauguggaacugauucggggaagaaaggaggaaaccgagguucucuggacauccaauucuaucguggucuucuguggcaccagcgggacauacggaacgggcuccuggcccgacggggcugaucugaaccuuaugccuauuuga

SEQ ID NO: 204218 - RNA, 1410 nt, Artificial Sequence; identical to SEQ ID NO: 202542
  derived and/or modified sequence opt5 from neuraminidase__InfluenzaA__AER08683

SEQ ID NO: 204219 - RNA, 1410 nt, Artificial Sequence; identical to SEQ ID NO: 204167
  derived and/or modified sequence opt5 from neuraminidase__InfluenzaA__AER08685

SEQ ID NO: 204220 - RNA, 1410 nt, Artificial Sequence; identical to SEQ ID NO: 204167
  derived and/or modified sequence opt5 from neuraminidase__InfluenzaA__AER08687

SEQ ID NO: 204221 - RNA, 1410 nt, Artificial Sequence
  derived and/or modified sequence opt5 from neuraminidase__InfluenzaA__AER08689
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuacacuuugugaacccaccauuaucgagagaaauauuacagaaaucguguaucugaccaacacgaccauugagaaggaaaucugcccuaaacucgcugaguaccggaauugguccaagccccagugugacauuacaggguucgccccuuuuucuaaagauaacagcauccgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcauugccugguccucuagcuccugucaugacggaaaagccuggcugcacgugugcaucaccggcgaugacaagaacgcuaccgccagcuucauuuacaauggccggcuuguugauucuguggucuccuggagcaaagagauccugcgcacacaggaaucugagugugugugcauuaacgggacguguaccguggucaugacagacggauccgcuagcggcaaggccgauaccaaaauccucuuuaucgaggaagggaagauuguucauacauccacccugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaaggaugacagcuccucuagcucccauugccuggauccgaauaacgaggaaggcgggcacggagugaaaggcugggccuucgacgaugggaaugacguuuggaugggacgcacaaucaacgagaccagcagacucggcuaugagaccuuuaaggugaucgaaggguggucuaauccuaaauccaagcugcagauuaaccggcaggucaucguggaucgcggaaauagaagcggcuacucuggcauuuucuccgucgaggggaaaagcuguaucaaccggugcuuuuauguggaacugauuagaggacgcaaggaggaaacagagguucucuggaccuccaauucuaucguggucuucuguggcacaagcgggacguacggaaccggcuccuggcccgacggggcugaucugaaccuuaugccuauuuga

SEQ ID NO: 204222 - RNA, 1410 nt, Artificial Sequence; identical to SEQ ID NO: 204167
  derived and/or modified sequence opt5 from neuraminidase__InfluenzaA__AER08691

SEQ ID NO: 204223 - RNA, 1410 nt, Artificial Sequence
  derived and/or modified sequence opt5 from neuraminidase__InfluenzaA__AER08693
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaagaaucagguuaugcuuugugaacccacaauuaucgagagaaacauuaccgaaaucguguaucugacaaauaccacgauugagaaagaaaucugcccuaagcucgcugaguaccggaacugguccaaaccccagugugacauuaccggguucgccccuuuuucuaaggauaauagcauccgccuguccgcgggaggcgacaucugggugacaagagagcccuaugucucuugcgauccugacaaguguuaccaauucgcucuugggcagggaaccacacugaacaaugugcauagcaacaauaccguucgggaucgcacgccguauagaacacuccugaugaacgaacugggcgugcccuuucaccucgggaccaaacaggucugcauugccugguccagcagcuccugucaugacggaaaggccuggcugcacgugugcaucacaggcgaugacaaaaaugcuaccgccagcuucauuuacaacggcaaacuuguugauucuguggucuccuggagcaaggagauccugcggacccaggaaucugagugugugugcauuaaugggacauguacgguggucaugaccgacggauccgcuagcggcaaggccgauacaaagauccucuuuaucgaggaagggaaaauuguucauaccuccacacugucuggaagcgcgcaacacguggaggaaugcuccugcuauccucgcuaccccggcgugagaugugucugccgggacaacuggaaggggagcaaccgcccuaucguggauauuaauaucaaagaccacucuauuguuuccagcuacguguguucuggacuugucggcgacacccccagaaagaacgauagcuccucuagcucccauugccuggacccgaauaacgaggaaggcgggcacggagugaaaggcugggccuucgaugacgggaaugauguuuggaugggacggacgaucaacgagacaagccgccucggcuaugagaccuuuaaggugaucgaaggguggucuaauccuaaauccaagcugcagauuaacagacaggucaucguggaccggggaaaucgcagcggcuacucuggcauuuucuccgucgaggggaagucuuguaucaacagaugcuuuuauguggaacugauucggggaagaaaagaggaaaccgagguucucuggacauccaauucuaucguggucuucuguggcaccagcgggacauacggaacgggcuccuggcccgauggggcugaccugaaccuuaugccuauuuga

SEQ ID NO: 204224 - RNA, 1410 nt, Artificial Sequence
  derived and/or modified sequence opt5 from neuraminidase__InfluenzaA__AER08697
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaccugcccuacacucgcugaguaccggaauugguccaaaccccagugugacaucaccggguucgccccuuuuucuaaggauaacagcauucgccuguccgcgggaggcgacaucugggugacaagagagcccuaugucucuugcgauccugacaaauguuaccaauucgcucuugggcagggaaccacgcugaauaacgugcauagcaauaacacaguucgggaucgcaccccguauagaacacuccugaugaaugaacugggcgugcccuuucaccucgggaccaagcaggucugcaucgccugguccagcagcuccugucaugacggaaaggccuggcugcacgugugcauuaccggcgaugacaaaaacgcuacagccagcuucaucuacaauggccggcuuguugauucuguggucuccuggagcaaggagauucugcgcacgcaggaaucugagugugugugcaucaacgggaccuguacaguggucaugaccgacggauccgcuagcggcaaagccgauacaaagauucucuuuaucgaggaagggaaaaucguucauaccuccacgcugucuggaagcgcgcaacacguggaggaaugcuccugcuauccuagauaccccggcgugcggugugucugccgcgacaacuggaaggggagcaauagaccuauuguggauaucaacauuaaggaccacucuaucguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccauuaaugugaccagcagacucggcuaugagacauuuaaagucaucgagggguggucuaacccuaaguccaaacugcagaucaaucgccaggugauugucgaccggggaaacagaagcggcuacucuggcaucuucuccguggaagggaagucuuguauuaaucggugcuuuuauguugagcugaucagaggacgcaaagaagagaccgaagugcucuggacauccaacucuauugucguguucuguggcacgagcgggaccuacggaacaggcuccuggcccgauggggcugaccugaaucuuaugccuaucuga

SEQ ID NO: 204225 - RNA, 1410 nt, Artificial Sequence; identical to SEQ ID NO: 204021
  derived and/or modified sequence opt5 from neuraminidase__InfluenzaA__AER92714

SEQ ID NO: 204226 - RNA, 1410 nt, Artificial Sequence; identical to SEQ ID NO: 199762
  derived and/or modified sequence opt5 from neuraminidase__InfluenzaA__AER92721

SEQ ID NO: 204227 - RNA, 1410 nt, Artificial Sequence; identical to SEQ ID NO: 199762
  derived and/or modified sequence opt5 from neuraminidase__InfluenzaA__AER92724

SEQ ID NO: 204228 - RNA, 1413 nt, Artificial Sequence
  derived and/or modified sequence opt5 from neuraminidase__InfluenzaA__AET84165
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugucugcuccuaacuuuuauuacgaagaguguagcugcuacccggacaccggcauugucaugugugugugccgggauaauuggcauggguccaaccgccccugggugagcuucaaucagaaccuugacuaucaaaucggauacauuugcucuggcgucuuuggggauaauccuagacccgaggacggagaaggcuccuguaacccuguuaccaucgauggcgccaauggggugaaaggauucagcuauaaguacggcaacgggguguggauuggacggacaaaaucuaaucgccugagaaagggcuuugagaugaucugggaccccaacggguggacgaauaccgacuccgauuucagcgucaaacaggacgugguugcgaucacagauugguccggcuauucuggcagcuuugugcagcacccggaacucaccggacuggacugcauucggccuuguuucugggucgagcuugugcgcgggcugcccagagaaaacacaaccaucuggacguccggaucuagcauuuccuucugcggcguuaacagcgauacagccaauuggucuuggccugacggggcugagcuccccuuuaccaucgauaaguga

SEQ ID NO: 204229 - RNA, 1413 nt, Artificial Sequence; identical to SEQ ID NO: 201954
  derived and/or modified sequence opt5 from neuraminidase__InfluenzaA__AET84176

SEQ ID NO: 204230 - RNA, 1413 nt, Artificial Sequence
  derived and/or modified sequence opt5 from neuraminidase__InfluenzaA__AET84187
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcauggacuggcugaccaucgggauuagcggaccugauaacggcgcggucgccgugcugaaguauaaugggaucauuacaggaaccaucaaaucuuggaagaaacagauucucagaacgcaggaguccgagugcguuuguaugaacggcagcugcuuuacaaucaugaccgacggccccucuaauaaggcugccagcuacaaaaucuucaagauugaaaaggggaaagugacaaaguccaucgagcugaacgcuccuaauuuuuauuacgaagaguguucuugcuacccggauaccggaauugucaugugugugugccgggacaacuggcauggcagcaaucgccccuggguguccuucaaccagaaucuugauuaucaaaucggguacauuugcagcggagucuuuggcgacaacccuagacccaaagauggggagggaucuuguaauccuguuaccaucgacggcgccaacggcgugaagggguucuccuauaaauacggaaauggcguguggauugggcggacaaagagcaaccgccugagaaaaggauuugaaaugaucugggaccccaauggcuggacgaacaccgauucugacuucuccgucaagcaggaugugguugcgaucacagacuggagcggguauuccggcucuuuugugcagcacccggagcucaccggacuggauugcauucggccuuguuucugggucgaacuugugcgcggccugcccagagagaacacaaccaucuggacgagcggguccucuauuagcuucugcggaguuaauuccgacacagccaacuggagcuggccugauggcgcugaacuccccuuuaccaucgacaaguga

SEQ ID NO: 204231 - RNA, 1413 nt, Artificial Sequence
  derived and/or modified sequence opt5 from neuraminidase__InfluenzaA__AET84198
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucuaugacacuggcgggcaacagcucccuuuguagcauuucugggugggcuaucuacaccaaggauaauuccauucggaucggaagcaaaggcgacguguucgucauucgcgagccuuuuaucucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucuguugccuggagcgcuuccgccugucacgauggcaugggguggcugaccaucggaauuagcggcccugacaacggggcgguggccguccugaaguauaauggaaucauuacaggcaccaucaaaucuuggaagaaacagauucucagaacgcaggaguccgagugcguguguaugaacggcagcugcuuuacaaucaugaccgaugggcccucuaauaaggcugccagcuacaaaaucuucaagauugaaaagggaaaaguuacaaaguccaucgagcugaacgcuccuaauuuuuauuacgaagaguguucuugcuacccggacaccggcauugugaugugugucugccgggauaacuggcaugggagcaaucgccccuggguguccuucaaccagaaucuugacuaucaaaucggauacauuugcagcggcguguuuggggauaacccuagacccaaagacggagagggcucuuguaauccugucaccguugauggcgccaacggggugaagggauucuccuauaaauacggcaaugggguguggaucggacggacaaagagcaaccgccugagaaaaggcuuugaaaugauuugggaccccaauggguggacgaacaccgacucugauuucuccgucaagcaggacgugguugcgaucacagauuggagcggcuauuccggaucuuuugugcagcacccggagcucaccggccuggacugcauccggccuuguuucugggucgaacuugugcgcgggcugcccagagagaacacaaccauuuggacgagcggauccucuaucagcuucugcggcguuaauuccgauacagccaacuggagcuggccugacggggcugaacuccccuuuaccauugauaaguga

SEQ ID NO: 204232 - RNA, 1413 nt, Artificial Sequence
  derived and/or modified sequence opt5 from neuraminidase__InfluenzaA__AET84209
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaaaguuguggccggagaagacaagaccucugugacacuggcgggcaauagcucccuuuguagcauuucugggugggcuaucaacaccaaagauaauuccauucggaucggaagcaagggcgacgucuucgugauucgcgagccuuuuaucucuugcucccaccuggaauguagaacguucuuucucacccaaggcgcccugcuuaacgauaaacauagcaaugggacaguuaaggaccggucuccguaccgcgcccugauguccugcccccucggagaggcuccuagccccuauaacuccaaguucgaaucuguggccuggagcgcuuccgccugucacgauggcaugggguggcugaccaucggaauuagcggcccugacaacggggcggucgccgugcugaaauacaauggaaucauuacaggcaccaucaagucuuggaaaaagcagauucucagaacgcaggaguccgagugcguuuguaugaacggcagcugcuuuacaaucaugaccgaugggcccucuaauaaagcugccagcuauaagaucuucaagauugaaaaaggaaaggugacaaaauccaucgagcugaacgcuccuaauuuuuacuaugaagaguguucuugcuacccggacaccggcauugucaugugugugugccgggauaacuggcaugggagcaaucgccccuggguguccuucaaccagaaucuugacuaccaaaucggauauauuugcagcggcgucuuuggggauaacccuagacccaaggacggagagggcucuuguaauccuguuaccguggauggcgccaacggggugaaaggauucuccuacaaguauggcaauggggucuggaucggacggacaaaaagcaaccgccugagaaagggcuuugaaaugauuugggaccccaauggguggacgaacaccgacucugauuucuccgugaagcaggacguuguggcgaucacagauuggagcggcuacuccggaucuuuuguccagcacccggagcucaccggccuggacugcauccggccuuguuucuggguggaacuuguucgcgggcugcccagagagaacacaaccauuuggacgagcggauccucuaucagcuucugcggcgucaauuccgauacagccaacuggagcuggccugacggggcugaacuccccuuuaccauugauaaauga

SEQ ID NO: 204233 - RNA, 1413 nt, Artificial Sequence
  derived and/or modified sequence opt5 from neuraminidase__InfluenzaA__AET84231
augaaccccaaucagaagaucauuaccaucggcagcauuuccaucgccauugggaucaucucucugaugcuccaaauuggaagcaucauuuccaucugggcuucucacagcauucauacaggcucccagaacaauacggggaucugcaaccagagaauuaucaccuacgaaaauucuacaugggugaaccacaccuaugucaauaucaacaauacaaacguuguggccggagaggacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaucuggaauguagaacguucuuucucacccagggcgcccugcuuaaugauaagcacucuaacgggacaguuaaagaccgguccccguaucgcgcccugaugagcugcccccucggagaggcuccuucccccuacaauucuaaguucgaaagcguggccugguccgcuagcgccugucaugauggcaugggguggcugaccaucggaauuucuggcccugacaacggggcggucgccgugcugaaguauaacggaaucauuacaggcaccaucaaauccuggaagaaacaaauucucagaacgcaggagagcgagugcguuuguaugaauggcucuugcuuuacaaucaugaccgaugggcccagcaacaaggcuuccucuuacaaaaucuucaagauugaaaagggaaaagugacaaagagcaucgagcugaaugccccuaacuuuuauuacgaagaguguuccugcuacccggacaccggcauugucaugugugugugccgggauaauuggcacgggagcaaccgccccugggugucuuucaaucagaaccuugacuaucagaucggauacauuugcuccggcgucuuuggggauaauccuagacccgaggacggagaaggcagcuguaacccuguuaccguggauggcgcuaauggggugaaaggauucucuuauaaguacggcaacggggucuggaucggacggacaaaauccaaucgccugagaaagggcuuugagaugauuugggaccccaacggguggacgaauaccgacagcgauuucuccgugaaacaagacguuguggccaucacagauuggucuggcuauagcggauccuuuguccagcacccggaacucaccggccuggacugcauccggccuuguuucuggguggagcuuguucgcgggcugcccagagaaaacacaaccauuuggacgucuggaagcuccaucagcuucugcggcgugaacucugauacagcgaauugguccuggccugacggggccgagcuccccuuuaccauugauaaguga

SEQ ID NO: 204234 - RNA, 1413 nt, Artificial Sequence; identical to SEQ ID NO: 200485
  derived and/or modified sequence opt5 from neuraminidase__InfluenzaA__AET84242

SEQ ID NO: 204235 - RNA, 1413 nt, Artificial Sequence
  derived and/or modified sequence opt5 from neuraminidase__InfluenzaA__AET84253
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgaaaauucuacaugggugaaccauaccuaugucaauaucaacaauacaaacguuguggccggagaggacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacagagaccaucaaauccuggaagaaacagauucucagaacgcaggagagcgaaugcguuuguaugaauggcucuugcuuuacaaucaugaccgauggccccagcaacaaggcugccuccuacaaaaucuucaagauugagaaggggaaagugacaaagucuaucgaacugaaugcuccuaacuuuuauuacgaggaguguagcugcuacccggacaccggaauugucaugugugugugccgggauaauuggcauggcuccaaccgccccugggugagcuucaaucagaaccuugacuaucaaaucggguacauuugcucuggagucuuuggcgauaauccuagacccgaagacggggagggauccuguaacccuguuaccguggauggcgccaauggcgugaaaggguucagcuauaaguacggaaacggcgucuggaucgggcggacaaaaucuaaucgccugagaaagggauuugaaaugauuugggaccccaacggcuggacgaauaccgacuccgauuucagcgugaaacaggacguuguggcgaucacagauugguccggguauucuggcagcuuuguccagcacccggagcucaccggacuggacugcauccggccuuguuucuggguggaacuuguucgcggccugcccagagagaacacaaccauuuggacguccgggucuagcaucuccuucugcggagugaacagcgauacagccaauuggucuuggccugacggcgcugagcuccccuuuaccauugauaaguga

SEQ ID NO: 204236 - RNA, 1413 nt, Artificial Sequence
  derived and/or modified sequence opt5 from neuraminidase__InfluenzaA__AET84264
augaaccccaaucagaagaucauuaccaucggcagcauuuccaucgccauugggaucaucucucugauguuccaaauuggaagcaucauuuccaucugggcuucucacagcauucagacaggcucccagaacaauacggggaucugcaaccagagaauuaucaccuacgaaaauucuacaugggugaaccauaccuaugucaauaucaacaauacaaacguuguggccggagaggacaaaaccagcgugacacucgcgggcaauuccagccuguguucuauuuccgggugggcuaucuacaccaaggauaacagcauucggaucggaucuaaaggcgacgucuuugugauucgcgagccuuucaucuccugcagccaccuugaauguagaacguuuuuccugacccaaggcgcccuccugaaugauaagcauucuaacgggacaguuaaagaccgguccccguaucgcgcccuuaugagcugcccccugggagaggcuccuucccccuacaauucuaaguuugaaagcguggccugguccgcuagcgccugucacgauggcaugggguggcucaccaucggaauuucuggcccugacaacggggcggucgccgugcugaaguauaacggaaucauuacagagaccaucaaauccuggaagaaacagauucugagaacgcaggagagcgaaugcguuuguaugaauggcucuugcuucacaaucaugaccgauggccccagcaacaaggcugccuccuacaaaaucuuuaagauugagaaggggaaagugacaaagucuaucgaacucaaugcuccuaacuucuauuacgaggaguguagcugcuacccggacaccggaauugucaugugugugugccgggauaauuggcauggcuccaaccgccccugggugagcuuuaaucagaaccuggacuaucaaaucggguacauuugcucuggagucuucggcgauaauccuagacccgaagacggggagggauccuguaacccuguuaccguggauggcgccaauggcgugaaaggguuuagcuauaaguacggaaacggcgucuggaucgggcggacaaaaucuaaucgccuuagaaagggauucgaaaugauuugggaccccaacggcuggacgaauaccgacuccgauuuuagcgugaaacaggacguuguggcgaucacagauugguccggguauucuggcagcuucguccagcacccggagcugaccggacucgacugcauccggccuuguuucuggguggaacugguucgcggccuucccagagagaacacaaccauuuggacguccgggucuagcaucuccuuuugcggagugaacagcgauacagccaauuggucuuggccugacggcgcugagcugcccuucaccauugauaaguga

SEQ ID NO: 204237 - RNA, 1413 nt, Artificial Sequence
  derived and/or modified sequence opt5 from neuraminidase__InfluenzaA__AET84275
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccaaagacggagagggcucuuguaauccuguuaccguggauggcgccaacggggugaagggauucuccuauaaauacggcaauggggucuggaucggacggacaaagagcaaccgccugagaaaaggcuuugaaaugauuugggaccccaauggguggacgaacaccgacucugauuucuccgugaagcaggacguuguggcgaucacagauuggagcggcuauuccggaucuuuuguccagcacccggagcucaccggccuggacugcauccggccuuguuucuggguggaacuuguucgcgggcugcccagagagaacacaaccauuuggacgagcggauccucuaucagcuucugcggcgucaauuccgauacagccaacuggagcuggccugacggggcugaacuccccuuuaccauugauaaguga

SEQ ID NO: 204238 - RNA, 1413 nt, Artificial Sequence; identical to SEQ ID NO: 200485
  derived and/or modified sequence opt5 from neuraminidase__InfluenzaA__AET84286

SEQ ID NO: 204239 - RNA, 1413 nt, Artificial Sequence
  derived and/or modified sequence opt5 from neuraminidase__InfluenzaA__AET84297
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacgacaauggcgucuggaucgggcggacaaaaagcaaccgccugagaaagggauuugagaugauuugggaccccaauggcuggacgaacaccgauucugacuucuccgugaaacaggauguuguggcgaucacagacuggagcggguauuccggcucuuuuguccagcacccggaacucaccggacuggauugcauccggccuuguuucuggguggagcuuguucgcggccugcccagagaaaacacaaccauuuggacgagcggguccucuaucagcuucugcggagucaauuccgacacaaccaacuggagcuggccugauggcgccgagcuccccuuuaccauugacaaguga

SEQ ID NO: 204240 - RNA, 1413 nt, Artificial Sequence
  derived and/or modified sequence opt5 from neuraminidase__InfluenzaA__AET84308
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacagagaccaucaaaucuuggaagaaacagauucucagaacgcaggaguccgaaugcguuuguaugaacggcagcugcuuuacaaucaugaccgauggccccucuaauaaggcugccagcuacaaaaucuucaagauugagaaggggaaagugacaaaguccaucgaacugaacgcuccuaauuuucauuaugaggaguguucuugcuacccggacaccggaauugucaugugugugugccgggauaacuggcacggcagcaaucgccccuggguguccuucaaccagaaucuugacuaccaaaucggguauauuugcagcggagucuuuggcgauaacccuagacccgaagacggggagggaucuuguaauccuguuaccguggauggcgccaacggcgugaaaggguucuccuacaaguaugacaauggagucuggaucggccggacaaaaagcaaccgccugagaaagggguuugaaaugauuugggaccccaauggauggacgaacaccgauucugacuucuccgugaaacaggauguuguggcgaucacagacuggagcggcuacuccgggucuuuuguccagcacccggagcucaccggccuggauugcauccggccuuguuucuggguggaacuuguucgcggacugcccagagagaacacaaccauuuggacgagcggcuccucuaucagcuucugcggggucaauuccgacacaaccaacuggagcuggccugauggagccgagcuccccuuuaccauugacaaguga

SEQ ID NO: 204241 - RNA, 1413 nt, Artificial Sequence
  derived and/or modified sequence opt5 from neuraminidase__InfluenzaA__AET84319
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucuaugacacuggcgggcaacagcucccuuuguagcauuucugggugggcuaucuacaccaaggauaauuccauucggaucggaagcaaaggcgacguguucgucauucgcgagccuuuuaucucuugcucccaccuggaauguagaacguucuuucucacccaaggcgcccugcuuaacgauaagcauagcaaucggacagugaaagaccgcucuccguauagagcccugauguccugcccccucggggaggcuccuagccccuacaacuccaaguucgaaucuguugccuggagcgcuuccgccugucacgauggaaugggcuggcugaccaucgggauuagcggaccugacaacggcgcgguggccguccugaaguauaaugggaucauuacagagaccaucaaaucuuggaagaaacagauucuccggacgcaggaguccgaaugcguguguaugaacggaagcugcuuuacaaucaugaccgauggccccucuaauaaggcugccagcuacaaaaucuucaagauugagaagggcaaaguuacaaaguccaucgaacugaacgcuccuaauuuuuauuacgaggaguguucuugcuacccggacaccgggauugugaugugugucugccgcgauaacuggcauggaagcaauagacccuggguguccuucaaccagaaucuugacuaucaaaucggcuacauuugcagcgggguguuuggagauaacccucggcccgaagacggcgaggggucuuguaauccugucaccguugauggagccaacggcgugaaaggcuucuccuauaaguacgggaauggaguguggaucggccgcacaaaaagcaacagacugcggaagggguuugaaaugauuugggaccccaauggauggacgaacaccgacucugauuucuccgucaaacaggacgugguugcgaucacagauuggagcggcuauuccgggucuuuugugcagcacccggagcucaccggccuggacugcauccgcccuuguuucugggucgaacuugugagaggacugccccgggagaacacaaccauuuggacgagcggcuccucuaucagcuucugcgggguuaauuccgauacagccaacuggagcuggccugacggagcugagcuccccuuuaccauugauaaguga

SEQ ID NO: 204242 - RNA, 1413 nt, Artificial Sequence
  derived and/or modified sequence opt5 from neuraminidase__InfluenzaA__AET84330
augaaccccaaucagagaaucauuaccaucggcagcauuuccaucgccauugggaucaucucucugaugcuccaaauuggaaacaucauuagcaucugggcuucccacucuauucagaucggcagccagaauaacacagggauuugcaaucagcggaucaucacguacgagaacuccaccugggugaaucauacauaugucaacauuaauaacaccaauguuguggccggagaagacaagacaucugugacccuggcgggcaacagcucccuuuguagcaucucugggugggcuauuuacacaaaagauaauuccauccgcauuggaagcaagggcgacgucuucgugaucagagagccuuuuaucucuugcucccaccuggaaugucggaccuucuuucucacgcaaggcgcccugcuuaacgauaaacauagcaaugggaccgccaaggaccgcucuccguauagagcucugauguccugcccccucggagaggccccuagccccuacaacuccaaauucgaaucuguugcuuggagcgccuccgcgugucacgauggcaugggguggcugacaauuggaaucagcggcccugacaacggggccguggcuguccugaaguauaauggaauuaucaccggcacaauuaagucuuggaaaaagcagauccuccggacccaggaguccgagugcguguguaugaacggcagcugcuuuacgaucaugacagaugggcccucuaauaaagccgcuagcuacaagauuuucaaaaucgaaaagggaaagguuaccaaauccauugagcugaacgccccuaauuuuuauuacgaagaguguucuugcuacccggacacaggcaucgugaugugugucugccgcgauaacuggcaugggagcaauagacccuggguguccuucaaccagaaucuugacuaucaaauuggauacaucugcagcggcguguuuggggauaacccucggcccaaggacggagagggcucuuguaauccugucaccguugauggcgcgaacggggugaaaggauucuccuauaaguacggcaaugggguguggauuggacgcaccaaaagcaacagacugcggaagggcuuugaaaugaucugggaccccaauggguggacaaacacggacucugauuucuccgucaaacaggacgugguugccaucaccgauuggagcggcuauuccggaucuuuugugcagcacccggagcucacaggccuggacugcauucgcccuuguuucugggucgaacuugugagagggcugccccgggagaacaccacaaucuggaccagcggauccucuauuagcuucugcggcguuaauuccgauacggcuaacuggagcuggccugacggggccgaacuccccuuuacaaucgauaaguga

SEQ ID NO: 204243 - RNA, 1413 nt, Artificial Sequence
  derived and/or modified sequence opt5 from neuraminidase__InfluenzaA__AET84341
augaaccccaaucagagaaucauuaccaucggcagcauuuccaucgccauugggaucaucucucugaugcuccaaauuggaaacaucauuagcaucugggcuucccacucuauucagaucggcagccagaauaacacagggauuugcaaucagcggaucaucacguacgagaacuccaccugggugaaucauacauaugucaacauuaauaacaccaauguuguggccggagaagacaagacaucugugacccuggcgggcaacagcucccuuuguagcaucucugggugggcuauuuacacaaaagauaauuccauccgcauuggaagcaagggcgacgucuucgugaucagagagccuuuuaucucuugcucccaccuggaaugucggaccuucuuucucacgcaaggcgcccugcuuaacgauaaacauagcaaugggaccgccaaggaccgcucuccguauagagcucugauguccugcccccucggagaggccccuagccccuacaacuccaaauucgaaucuguugcuuggagcgccuccgcgugucacgauggcaugggguggcugacaauuggaaucagcggcccugacaacggggccguggcuguccugaaguauaauggaauuaucaccggcacaauuaagucuuggaaaaagcagauccuccggacccaggaguccgagugcguguguaugaacggcagcugcuuuacgaucaugacagaugggcccucuaauaaagccgcuagcuacaagauuuucaaaaucgaaaagggaaagguuaccaaauccauugagcugaacgccccuaauuuuuauuacgaagaguguucuugcuacccggacacaggcaucgugaugugugucugccgcgauaacuggcaugggagcaauagacccuggguguccuucaaccagaaucuugacuaucaaauuggauacaucugcagcggcguguuuggggauaacccucggcccaaggacggagagggcucuuguaauccugucaccguugauggcgcgaacggggugaaaggauucuccuauaaguacggcaaugggguguggauuggacgcaccaaaagcaacagacugcggaagggcuuugaaaugaucugggaccccaauggguggacaaacacggacucugauuucuccgucaaacaggacgugguugccaucaccgauuggagcggcuauuccggaucuuuugugcagcacccggagcucacaggccuggacugcauucgcccuuguuucugggucgaacuugugagagggcugcccaaggagaacaccacaaucuggaccagcggauccucuauuagcuucugcggcguuaauuccgauacggcuaacuggagcuggccugacggggccgaacuccccuuuacaaucgauaaguga

SEQ ID NO: 204244 - RNA, 1413 nt, Artificial Sequence
  derived and/or modified sequence opt5 from neuraminidase__InfluenzaA__AET84363
augaaccccaaucagagaaucauuaccaucggcagcauuuccaucgccauugggaucaucucucugaugcuccaaauuggaaacaucauuagcaucugggcuucccacucuauucagacaggcagccagaauaacacggggaucugcaaucagcggauuaucaccuacgagaacuccacaugggugaaucauaccuaugugaacaucaauaacacaaauguuguggccggagaagacaagaccucuaugacacuggcgggcaacagcucccuuuguagcauuucugggugggcuaucuacaccaaagauaauuccauucgcaucggaagcaagggcgacguguucgucauuagagagccuuuuaucucuugcucccaccuggaaugucggacguucuuucucacccaaggcgcccugcuuaacgauaaacauagcaaugggacagccaaggaccgcucuccguauagagcucugauguccugcccccucggagaggccccuagccccuacaacuccaaauucgaaucuguggcuuggagcgccuccgcgugucacgauggcaugggguggcugaccaucggaauuagcggcccugacaacggggccguugcugugcugaaguauaauggaaucauuacaggcaccaucaagucuuggaaaaagcagauucuccggacgcaggaguccgagugcgucuguaugaacggcagcugcuuuacaaucaugaccgaugggcccucuaauaaagccgcuagcuacaagaucuucaaaauugaaaagggaaaggugacaaaauccaucgagcugaacgccccuaauuuuuauuacgaagaguguucuugcuacccggacaccggcauuguuaugugugugugccgcgauaacuggcaugggagcaauagacccugggucuccuucaaccagaaucuugacuaucaaaucggauacauuugcagcggcguguuuggggauaacccucggcccaaggacggagagggcucuuguaauccugugaccgucgauggcgcgaacgggguuaaaggauucuccuauaaguacggcaaugggguguggaucggacgcacaaaaagcaacagacugcggaagggcuuugaaaugauuugggaccccaauggguggacgaacaccgacucugauuucuccgugaaacaggacgucguggccaucacagauuggagcggcuauuccggaucuuuuguucagcacccggagcucaccggccuggacugcauccgcccuuguuucuggguggaacuugucagagggcugccccgggagaacacaaccauuuggacgagcggauccucuaucagcuucugcggcgucaauuccgauacagcuaacuggagcuggccugacggggccgaacuccccuuuaccauugauaaguga

SEQ ID NO: 204245 - RNA, 1413 nt, Artificial Sequence
  derived and/or modified sequence opt5 from neuraminidase__InfluenzaA__AET84374
augaaccccaaucagagaaucauuaccaucggcagcauuuccaucgccauugggaucaucucucugaugcuccaaauuggaaacaucauuagcaucugggcuucccacucuauucagaucggcagccagaauaacacagggauuugcaaucagcggaucaucacguacgagaacuccaccugggugaaucauacauaugucaacauuaauaacaccaauguuguggccggagaagacaagacaucugugacccuggcgggcaacagcucccuuuguagcaucucugggugggcuauuuacacaaaagauaauuccauccgcauuggaagcaagggcgacgucuucgugaucagagagccuuuuaucucuugcucccaccuggaaugucggaccuucuuucucacgcaaggcgcccugcuuaacgauaaacauagcaaugggaccgccaaggaccgcucuccguauagagcucugauguccugcccccucggagaggccccuagccccuacaacuccaaauucgaaucuguugcuuggagcgccuccgcgugucacgauggcaugggguggcugacaauuggaaucagcggcccugacaacggggccguggcuguccugaaguauaauggaauuaucaccgagacaauuaagucuuggaaaaagcagauccuccggacccaggaguccgaaugcguguguaugaacggcagcugcuuuacgaucaugacagauggccccucuaauaaagccgcuagcuacaagauuuucaaaaucgagaaggggaagguuaccaaauccauugaacugaacgccccuaauuuuuauuacgaggaguguucuugcuacccggacacaggaaucgugaugugugucugccgcgauaacuggcauggcagcaauagacccuggguguccuucaaccagaaucuugacuaucaaauuggguacaucugcagcggaguguuuggcgauaacccucggcccaaggacggggaaggaucuuguaauccugucaccguugauggcgcgaacggcgugaaaggguucuccuauaaguacggaaauggcguguggauugggcgcaccaaaagcaacagacugcggaagggauuugagaugaucugggaccccaauggcuggacaaacacggacucugauuucuccgucaaacaggacgugguugccaucaccgauuggagcggguauuccggcucuuuugugcagcacccggaacucacaggacuggacugcauucgcccuuguuucugggucgagcuugugagaggccugccccgggaaaacaccacaaucuggaccagcggguccucuauuagcuucugcggaguuaauuccgauacggcuaacuggagcuggccugacggcgccgagcuccccuuuacaaucgauaaguga

SEQ ID NO: 204246 - RNA, 1413 nt, Artificial Sequence
  derived and/or modified sequence opt5 from neuraminidase__InfluenzaA__AET84396
augaaccccaaucagagaaucauuaccaucggcagcauuuccaucgccauugggaucaucucucugaugcuccaaauuggaaacaucauuagcaucugggcuucccacucuauucagacaggcagccagaauaacacggggaucugcaaucagcggauuaucaccuacgagaacuccacaugggugaaucauaccuaugugaacaucaauaacacaaauguuguggccggagaagacaagaccucuaugacacuggcgggcaacagcucccuuuguagcauuucugggugggcuaucuacaccaaagauaauuccauucgcaucggaagcaagggcgacguguucgucauuagagagccuuuuaucucuugcucccaccuggaaugucggacguucuuucucacccaaggcgcccugcuuaacgauaaacauagcaaugggacagccaaggaccgcucuccguauagagcucugauguccugcccccucggagaggccccuagccccuacaacuccaaauucgaaucuguggcuuggagcgccuccgcgugucacgauggcaugggguggcugaccaucggaauuagcggcccugacaacggggccguugcugugcugaaguauaauggaaucauuacagagaccaucaagucuuggaaaaagcagauucuccggacgcaggaguccgaaugcgucuguaugaacggcagcugcuuuacaaucaugaccgauggccccucuaauaaagccgcuagcuacaagaucuucaaaauugagaaggggaaggugacaaaauccaucgaacugaacgccccuaauuuuuauuacgaggaguguucuugcuacccggacaccggaauuguuaugugugugugccgcgauaacuggcauggcagcaauagacccugggucuccuucaaccagaaucuugacuaucaaaucggguacauuugcagcggaguguuuggcgauaacccucggcccaaggacggggaaggaucuuguaauccugugaccgucgauggcgcgaacggcguuaaaggguucuccuauaaguacggaaauggcguguggaucgggcgcacaaaaagcaacagacugcggaagggauuugagaugauuugggaccccaauggcuggacgaacaccgacucugauuucuccgugaaacaggacgucguggccaucacagauuggagcggguauuccggcucuuuuguucagcacccggaacucaccggacuggacugcauccgcccuuguuucuggguggagcuugucagaggccugccccgggaaaacacaaccauuuggacgagcggguccucuaucagcuucugcggagucaauuccgauacagcuaacuggagcuggccugacggcgccgagcuccccuuuaccauugauaaguga

SEQ ID NO: 204247 - RNA, 1413 nt, Artificial Sequence
  derived and/or modified sequence opt5 from neuraminidase__InfluenzaA__AET84407
augaaccccaaucagagaaucauuaccaucggcagcauuuccaucgccauugggaucaucucucugaugcuccaaauuggaaacaucauuagcaucugggcuucccacucuauucagaucggcagccagaauaacacagggauuugcaaucagcggaucaucacguacgagaacuccaccugggugaaucauacauaugucaacauuaauaacaccaauguuguggccggagaagacaagacaucugugacccuggcgggcaacagcucccuuuguagcaucucugggugggcuauuuacacaaaagauaauuccauccgcauuggaagcaagggcgacgucuucgugaucagagagccuuuuaucucuugcucccaccuggaaugucggaccuucuuucucacgcaaggcgcccugcuuaacgauaaacauagcaaugggaccgccaaggaccgcucuccguauagagcucugauguccugcccccucggagaggccccuagccccuacaacuccaaauucgaaucuguugcuuggagcgccuccgcgugucacgauggcaugggguggcugacaauuggaaucagcggcccugacaacggggccguggcuguccugaaguauaauggaauuaucaccggcacaauuaagucuuggaaaaagcagauccuccggacccaggaguccgagugcguguguaugaacggcagcugcuuuacgaucaugacagaugggcccucuaauaaagccgcuagcuacaagauuuucaaaaucgaaaagggaaagguuaccaaauccauugagcugaacgccccuaauuuuuauuacgaagaguguucuugcuacccggacacaggcaucgugaugugugucugccgcgauaacuggcaugggagcaauagacccuggguguccuucaaccagaaucuugacuaucaaauuggauacaucugcagcggcguguuuggggauaacccucggcccgaggacggagaaggcucuuguaauccugucaccguugauggcgcgaacggggugaagggauucuccuauaaauacggcaaugggguguggauuggacgcaccaagagcaacagacugcggaaaggcuuugagaugaucugggaccccaauggguggacaaacacggacucugauuucuccgucaagcaggacgugguugccaucaccgauuggagcggcuauuccggaucuuuugugcagcacccggaacucacaggccuggacugcauucgcccuuguuucugggucgagcuugugagagggcugccccgggaaaacaccacaaucuggaccagcggauccucuauuagcuucugcggcguuaauuccgauacggcuaacuggagcuggccugacggggccgagcuccccuuuacaaucgauaaauga

SEQ ID NO: 204248 - RNA, 1413 nt, Artificial Sequence
  derived and/or modified sequence opt5 from neuraminidase__InfluenzaA__AET84418
augaaccccaaucagagaaucauugccaucggcagcauuuccaucgcuauugggaucaucucucugaugcuccaaauuggaaacaucauuagcaucugggccucccacucuauucagaucggcagccagaauaacaccgggauuugcaaucagcggaucaucacauacgagaacuccacgugggugaaucauaccuaugucaacauuaauaacacaaauguuguggcgggagaagacaagaccucugugacacuggcuggcaacagcucccuuuguagcaucucugggugggccauuuacaccaaagauaauuccauccgcauuggaagcaagggcgacgucuucgugaucagagagccuuuuaucucuugcucccaccuggaaugucggacauucuuucucacccaaggcgcccugcuuaacgauaaacauagcaaugggacggcuaaggaccgcucuccguauagagcccugauguccugcccccucggagaggcuccuagccccuacaacuccaaauucgaaucuguugccuggagcgcguccgccugucacgauggcaugggguggcugaccauuggaaucagcggcccugacaacggggcuguggccguccugaaguauaauggaauuaucacagagaccauuaagucuuggaaaaagcagauccuccggacacaggaguccgaaugcguguguaugaacggcagcugcuuuaccaucaugacggauggccccucuaauaaagcugccagcuacaagauuuucaaaaucgagaaggggaagguuacaaaauccauugaacugaacgcgccuaauuuuuauuacgaggaguguucuugcuacccggacaccggaaucgugaugugugucugccgcgauaacuggcauggcagcaauagacccuggguguccuucaaccagaaucuugacuaucaaauuggguacaucugcagcggaguguuuggcgauaacccucggcccgaagacggggagggaucuuguaauccugucacaguugauggcgccaacggcgugaagggguucuccuauaaauacggaaauggcguguggauugggcgcaccaagagcaacagacugcggaaaggauuugaaaugaucugggaccccaauggcuggaccaacacagacucugauuucuccgucaagcaggacgugguugcuaucacggauuggagcggguauuccggcucuuuugugcagcacccggagcucaccggacuggacugcauucgcccuuguuucugggucgaacuugugagaggccugccccgggagaacacaaccaucuggacaagcggguccucuauuagcuucugcggaguuaauuccgauaccgccaacuggagcuggccugacggcgcugagcuccccuuuacgaucgauaaauga

SEQ ID NO: 204249 - RNA, 1413 nt, Artificial Sequence
  derived and/or modified sequence opt5 from neuraminidase__InfluenzaA__AET84429
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucucuaucaacaauacaaacguuguggccggaaaagacaagaccagcgugacacuggcgggcaauuccagccuuuguucuauuuccgggugggcuaucuacaccaaagauaacagcauucggaucggaucuaagggcgacgucuucgugauucgcgaaccuuuuaucuccugcagccaccuggaguguagaacguucuuucucacccaaggcgcccugcuuaaugauaaacauucuaacgggacaguuaaggaccgguccccguaucgcgcccugaugagcugcccccucggagaagcuccuucccccuacaauucuaaguucgagagcguggccugguccgcuagcgccugucacgauggcaugggguggcugaccaucggaauuucuggcccugacaacggggcggucgccgugcugaaauauaacggaaucauuacaggcaccaucaaguccuggaaaaagcagauucucagaacgcaggaaagcgagugcguuuguaugaauggcucuugcuuuacaaucaugaccgaugggcccagcaacaaagcugccuccuacaagaucuucaagauugagaaaggaaaggugacaaaaucuaucgaacugaaugcuccuaacuuuuauuacgaggaauguagcugcuacccggacaccggcauugucaugugugugugccgggauaauuggcauggguccaaccgccccugggugagcuucaaucaggaccuugauuaucaaaucggauacauuugcucuggcgucuuuggggacaacccuagacccaaggauggagagggcuccuguaauccuguuaccguggacggcgccaacggggugaaaggauucagcuauaaguacggcaauggggucuggaucggacggacaaaaucuaaccgccugagaaagggcuuugagaugauuugggaccccaauggguggacgaacaccgauuccgacuucagcgugaagcaggauguuguggcgaucacagacugguccggcuauucuggcagcuuuguccagcacccggaacucaccggacuggauugcauccggccuuguuucuggguggagcuuguucgcgggcugcccagagaaaauacaaccauuuggacguccggaucuagcaucuccuucugcggcgugaacagcgacacagccaacuggucuuggccugauggggcugagcuccccuuuaccauugacaaauga

SEQ ID NO: 204250 - RNA, 1413 nt, Artificial Sequence
  derived and/or modified sequence opt5 from neuraminidase__InfluenzaA__AET84440
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacagagaccaucaaaucuuggaagaaacagauucucagaacgcaggaguccgaaugcguuuguaugaacggcagcugcuuuacaaucaugaccgauggccccucuaauaaggcugccagcuacaaaaucuucaagauugagaaggggaaagugacaaaguccaucgaacugaacgcuccuaauuuuuauuacgaggaguguucuugcuacccggacaccggaauugucaugugugugugccgggauaacuggcauggcagcaaucgccccuggguguccuucaaccagaaucuugacuaucaaaucggguacauuugcagcggagucuuuggcgauaacccuagacccaaagacggggaaggaucuuguaauccuguuaccguggauggcgccaacggcgugaagggguucuccuauaaauacggaaauggcgucuggaucgggcggacaaagagcaaccgccugagaaaaggauuugagaugauuugggaccccaauggcuggacgaacaccgacucugauuucuccgugaagcaggacguuguggcgaucacagauuggagcggguauuccggcucuuuuguccagcacccggaacucaccggacuggacugcauccggccuuguuucuggguggagcuuguucgcggccugcccagagaaaacacaaccauuuggacgagcggguccucuaucagcuucugcggagucaauuccgauacagccaacuggagcuggccugacggcgcugagcuccccuuuaccauugauaaguga

SEQ ID NO: 204251 - RNA, 1413 nt, Artificial Sequence
  derived and/or modified sequence opt5 from neuraminidase__InfluenzaA__AET84451
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguuguggccgagaaagacaagaccucugugacacuggcgggaaacagcucccuuuguagcaucucuggcugggcuauuuacaccaaagauaauuccauccggauugggagcaagggagacgucuucgugauccgcgagccuuuuaucucuugcucccaccuggaauguagaacguucuuucucaccaaaggcgcccugcuuaacgauaagcauagcaauggcacaguuaccgaccggucuccguaucgcgcccugauguccugcccccucggggaggcuccuagccccuacaacuccagauucgaaucuguggccuggagcgcuuccgccugucacgauggaaugggcuggcugacaauugggaucagcggaccugacaacggcgcggucgccgugcugaaguauaaugggauuaucaccgagacgauuaaaucuuggaagaaacggauccuccgcacacaagaguccgaaugcguuuguaugaacggaagcugcuuuaccaucaugacagauggccccucuaauggcgcugccagcuacaagauuuucaaaaucgagaaggggaaggugaccaaaaccauugaacugaacgcuccuaauuuucauuaugaggaguguuccugcuacccggacacaggaacggucaugugugugugcagagauaacuggcacggcucuaaucggcccugggugagcuucaaccagaaucuugacuaccagaucggguauauuugcuccggagucuuuggcgauaacccucgccccaaggacggggaaggaagcuguaauccuguuaccguggauggcgccgacggcgugaaaggguucucuuacaaguauggaaacggcgucuggaucgggagaacaaaauccaaucggcugcgcaagggauuugagaugauuugggaccccaacggcuggaccaauacagauagcgacuucucugugaaacaggauguuguggcgaucaccgacugguccggguacagcggcuccuuuguccaacacccggaacucacgggacuggauugcaucagaccuuguuucuggguggagcuuguucggggccugccccgcgaaaacacaaccauuuggaccucugggagcuccaucucuuucugcggagugaacagcggcacagccaauugguccuggccugacggggcugagcuccccuuuaccauugauaaguga

SEQ ID NO: 204252 - RNA, 1410 nt, Artificial Sequence; identical to SEQ ID NO: 199762
  derived and/or modified sequence opt5 from neuraminidase__InfluenzaA__AEV53421

SEQ ID NO: 204253 - RNA, 1410 nt, Artificial Sequence; identical to SEQ ID NO: 199762
  derived and/or modified sequence opt5 from neuraminidase__InfluenzaA__AEV53423

SEQ ID NO: 204254 - RNA, 1410 nt, Artificial Sequence; identical to SEQ ID NO: 201224
  derived and/or modified sequence opt5 from neuraminidase__InfluenzaA__AEV53425

SEQ ID NO: 204255 - RNA, 1410 nt, Artificial Sequence; identical to SEQ ID NO: 199762
  derived and/or modified sequence opt5 from neuraminidase__InfluenzaA__AEV53427

SEQ ID NO: 204256 - RNA, 1410 nt, Artificial Sequence; identical to SEQ ID NO: 201224
  derived and/or modified sequence opt5 from neuraminidase__InfluenzaA__AEV53429

SEQ ID NO: 204257 - RNA, 1410 nt, Artificial Sequence
  derived and/or modified sequence opt5 from neuraminidase__InfluenzaA__AEV53431
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucccugugaaacuugcgggaaauuccucucugugcccgguuagcggcugggcuauuuacuccaaggacaacagcaucagaaucgggucuaaaggagauguguuugucauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggaggugcccucuccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccgugaugacggauggacccuccgacggccaggccagcuacaaaauuuuucgcaucgaaaagggcaaaaucgucaagucuguugagaugaaugcuccuaacuaucauuacgaagagugcagcuguuaccccgauuccucugagauuacaugcgugugcagagacaauuggcacgggagcaaccggccuuggguguccuucaaucagaaccuggaauaucagaucggauacauuuguagcggcaucuuuggggauaauccccgcccgaacgacaaaaccggaucuugcggcccugucuccagcaauggggccaacggagugaagggcuucucuuuuaaguauggcaacgggguuuggauuggaagaacaaaauccaucagcucccggaauggcuucgagaugauuugggaucccaacggguggaccggaaccgacaauaacuuuucuaucaagcaagacaucgugggcauuaaugaauggagcggguacuccggcucuuucguccagcauccugagcuuacaggacuggauuguauccgccccugcuucuggguggaacucauuagaggccggcccaaagagaacacgaucuggaccagcggguccagcauuucuuuuuguggaguuaauuccggcacagugggguggagcuggccugacggagcugagcugccguucaccaucgauaaguga

SEQ ID NO: 204258 - RNA, 1410 nt, Artificial Sequence; identical to SEQ ID NO: 199762
  derived and/or modified sequence opt5 from neuraminidase__InfluenzaA__AEV53435

SEQ ID NO: 204259 - RNA, 1410 nt, Artificial Sequence
  derived and/or modified sequence opt5 from neuraminidase__InfluenzaA__AEV53437
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauacacuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 204260 - RNA, 1410 nt, Artificial Sequence; identical to SEQ ID NO: 199762
  derived and/or modified sequence opt5 from neuraminidase__InfluenzaA__AEV53439

SEQ ID NO: 204261 - RNA, 1410 nt, Artificial Sequence; identical to SEQ ID NO: 199762
  derived and/or modified sequence opt5 from neuraminidase__InfluenzaA__AEV53441

SEQ ID NO: 204262 - RNA, 1410 nt, Artificial Sequence; identical to SEQ ID NO: 199762
  derived and/or modified sequence opt5 from neuraminidase__InfluenzaA__AEV53443

SEQ ID NO: 204263 - RNA, 1410 nt, Artificial Sequence
  derived and/or modified sequence opt5 from neuraminidase__InfluenzaA__AEV53445
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgaccauaauuuuagcaucaagcaagacaucgugggcauuaacgaaugguccggguacucuggcagcuucguccagcaccccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 204264 - RNA, 1410 nt, Artificial Sequence; identical to SEQ ID NO: 199762
  derived and/or modified sequence opt5 from neuraminidase__InfluenzaA__AEV53447

SEQ ID NO: 204265 - RNA, 1410 nt, Artificial Sequence; identical to SEQ ID NO: 201664
  derived and/or modified sequence opt5 from neuraminidase__InfluenzaA__AEV53449

SEQ ID NO: 204266 - RNA, 1410 nt, Artificial Sequence
  derived and/or modified sequence opt5 from neuraminidase__InfluenzaA__AEV53451
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccgauuaucauuacgaagagugcuccuguuacccugacucuagcgagauuacaugcgugugccgcgauaacuggcacggguccaauagacccugggugagcuucaaccagaaucuggaauaucagaucggauacauuuguucuggcaucuuuggggacaacccucggcccaaugauaagaccggauccugcggcccggucagcucuaacggggccaauggagugaagggcuucuccuuuaaauauggcaacgggguuuggauuggacgcacaaagagcaucuccucuagaaacggcuucgagaugauuugggacccuaauggguggaccggaaccgacaacaauuuuagcaucaaacaagauaucgugggcauuaacgaaugguccggguacucuggcagcuucguccagcaucccgagcuuacaggacuggacuguauccggccuugcuucuggguggaacucauucgcggcagacccaaggagaauacgaucuggaccuccgggagcucuauuuccuuuuguggaguuaacagcgauacagugggcuggucuuggcccgacggggcugagcugccuuucaccaucgauaaauga

SEQ ID NO: 204267 - RNA, 1410 nt, Artificial Sequence; identical to SEQ ID NO: 199762
  derived and/or modified sequence opt5 from neuraminidase__InfluenzaA__AEV53453

SEQ ID NO: 204268 - RNA, 1410 nt, Artificial Sequence
  derived and/or modified sequence opt5 from neuraminidase__InfluenzaA__AEV53455
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccgaaaccgacaauaacuuuagcaucaagcaagacaucgugggaauuaaugagugguccggcuacucugggagcuucguccagcaucccgaacuuacaggccugaacuguauccgcccuugcuucuggguggagcucauuagaggacggcccaaagagaauacgaucuggaccuccggcagcucuauuuccuuuugugggguuaacagcgauacagugggauggucuuggcccgacggcgcugaacugccuuucaccaucgauaaguga

SEQ ID NO: 204269 - RNA, 1410 nt, Artificial Sequence
  derived and/or modified sequence opt5 from neuraminidase__InfluenzaA__AEV53457
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcgucgaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 204270 - RNA, 1410 nt, Artificial Sequence
  derived and/or modified sequence opt5 from neuraminidase__InfluenzaA__AEV53459
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugauuacggauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccgaaaccgacaauaacuuuagcaucaagcaagacauugugggaaucaaugagugguccggcuacucugggagcuucguccagcaucccgaacuuacaggccugaacuguauucgcccuugcuucuggguggagcucaucagaggacggcccaaagagaauacgauuuggaccuccggcagcucuaucuccuuuugugggguuaacagcgauacagugggauggucuuggcccgacggcgcugaacugccuuucaccaucgauaaguga

SEQ ID NO: 204271 - RNA, 1410 nt, Artificial Sequence; identical to SEQ ID NO: 199762
  derived and/or modified sequence opt5 from neuraminidase__InfluenzaA__AEV53461

SEQ ID NO: 204272 - RNA, 1410 nt, Artificial Sequence
  derived and/or modified sequence opt5 from neuraminidase__InfluenzaA__AEV53463
augaaccccaaucagaagaucauuaccaucggcagcgugugcaugacaauugggauggccaaccugauccuccaaauuggaaauaucaucuccauuuggaucucucacagcauucagcuggagaaccagaaucagaucgaaacguguaaccaauccgucauuaccuacgagaauaacacauggguuaaucagaccuaugugaacaucucuaauacaaacuucgcugccggccagagcguggucuccgugaaacuugcggggaauagcagccugugcccuguuuccggaugggcuauuuacagcaaggacaacucuaucagaaucggcuccaaaggggauguguuugucauucgggaaccguucaucagcuguucuccccucgagugccgcaccuuuuuccugacacagggagcccuucugaaugacaagcauuccaacggcaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcauuaacggcuccuguuucaccgugaugacggaugggccgagcgacggacaggccucuuacaaaaucuuucgcaucgagaagggcaaaauugugaagucugucgaaaugaaugcucccaacuaucauuacgaggagugcuccuguuacccugauucuagcgaaaucacaugcguuugcagagacaauuggcacggcuccaaccggcccugggugagcuucaaucagaaccuggaguaucagauuggguacaucuguucuggaauuuuuggcgauaauccucgccccaacgacaaaaccggguccugcggaccggugagcucuaauggcgccaacggggucaagggauucuccuuuaaguauggcaacggcguguggaucgggagaacaaaaagcauuuccucucggaauggauucgaaaugaucugggauccuaacggcuggaccgggaccgacaauaacuuuagcaucaagcaagacauuguuggaaucaaugagugguccggcuacucugggagcuucgugcagcaucccgaacuuacaggccuggauuguauucgcccuugcuucugggucgagcucaucagaggacggcccaaagagaacacgauuuggaccuccggcagcucuaucuccuuuuguggggugaauagcgacacaguuggauggucuuggcccgauggcgcugaacugccuuucaccaucgacaaguga

SEQ ID NO: 204273 - RNA, 1410 nt, Artificial Sequence
  derived and/or modified sequence opt5 from neuraminidase__InfluenzaA__AEV53465
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgaccgccaggccucuuacaaaauuuuuagaaucgaaaagggcaaaaucgucaagagcguugagaugaaugcucccaacuaucauuacgaagagugcuccuguuacccugauucuagcgagauuacaugcgugugccgggacaauuggcacggcuccaaccgccccugggugagcuucaaucagaaccuggaauaucagaucggguacauuuguucuggaaucuuuggcgauaauccuagacccaacgacaaaaccggguccugcggaccggucagcucuaauggcgccaacggggugaagggauucuccuauaaguacggcaacggcguuuggauugggcggacaaaaagcaucuccucucgcaauggauuugagaugauuugggauccuaacggcuggaccgggaccgacaauaacuucagcaucaagcaagacaucgugggaauuaaugaaugguccggcuauucugggagcuuuguccagcaucccgagcuuacaggccuggauuguaucagaccuugcuucuggguggaacucauucggggacgccccaaagagaacacgaucuggaccuccggcagcucuauuuccuucugugggguuaauagcgacacagugggauggucuuggcccgauggcgcugagcugccuuuuaccaucgacaaguga

SEQ ID NO: 204274 - RNA, 1410 nt, Artificial Sequence; identical to SEQ ID NO: 201563
  derived and/or modified sequence opt5 from neuraminidase__InfluenzaA__AEV53467

SEQ ID NO: 204275 - RNA, 1410 nt, Artificial Sequence; identical to SEQ ID NO: 201563
  derived and/or modified sequence opt5 from neuraminidase__InfluenzaA__AEV53469

SEQ ID NO: 204276 - RNA, 1410 nt, Artificial Sequence; identical to SEQ ID NO: 199762
  derived and/or modified sequence opt5 from neuraminidase__InfluenzaA__AEV53471

SEQ ID NO: 204277 - RNA, 1410 nt, Artificial Sequence; identical to SEQ ID NO: 199762
  derived and/or modified sequence opt5 from neuraminidase__InfluenzaA__AEV53473

SEQ ID NO: 204278 - RNA, 1410 nt, Artificial Sequence; identical to SEQ ID NO: 199762
  derived and/or modified sequence opt5 from neuraminidase__InfluenzaA__AEV53475

SEQ ID NO: 204279 - RNA, 1410 nt, Artificial Sequence; identical to SEQ ID NO: 199762
  derived and/or modified sequence opt5 from neuraminidase__InfluenzaA__AEV53477

SEQ ID NO: 204280 - RNA, 1410 nt, Artificial Sequence; identical to SEQ ID NO: 199762
  derived and/or modified sequence opt5 from neuraminidase__InfluenzaA__AEV53479

SEQ ID NO: 204281 - RNA, 1410 nt, Artificial Sequence; identical to SEQ ID NO: 199762
  derived and/or modified sequence opt5 from neuraminidase__InfluenzaA__AEV53481

SEQ ID NO: 204282 - RNA, 1410 nt, Artificial Sequence; identical to SEQ ID NO: 199762
  derived and/or modified sequence opt5 from neuraminidase__InfluenzaA__AEV53483

SEQ ID NO: 204283 - RNA, 1410 nt, Artificial Sequence
  derived and/or modified sequence opt5 from neuraminidase__InfluenzaA__AEV53485
augaaccccaaucagaagaucauuaccaucggcagcgugugcaugacaauugggauggccaaccugauccuccaaauuggaaauaucaucuccauuugggucucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 204284 - RNA, 1410 nt, Artificial Sequence; identical to SEQ ID NO: 201563
  derived and/or modified sequence opt5 from neuraminidase__InfluenzaA__AEV53487

SEQ ID NO: 204285 - RNA, 1410 nt, Artificial Sequence; identical to SEQ ID NO: 200780
  derived and/or modified sequence opt5 from neuraminidase__InfluenzaA__AEV53489

SEQ ID NO: 204286 - RNA, 1410 nt, Artificial Sequence
  derived and/or modified sequence opt5 from neuraminidase__InfluenzaA__AEV53491
augaaccccaaucagaagaucauuaccaucggccuggugugcaugacaauugggauggccaaccucauccugcaaauuggaaauaucaucagcauuuggaucucccacucuauucagcuuggcaaccagaaucagaucgagacguguaaccaaagcgucauuaccuacgaaaauaacacauggguuaaucagaccuaugugaacaucuccaauacaaacuucgcugccgggcagucuguggucagcgugaaacuggcgggaaauuccucucucugcccuguuagcggcugggcuauuuacuccaaggacaacagcaucagaaucgggucuaaaggagauguguuugucauucgggagccguucaucuccuguagcccccuggaaugccgcaccuuuuuccuuacacagggcgcccugcucaaugacaagcauucuaacggcaccauuaaagauagauccccuuaucggacgcugaugagcugucccaucggggaggugccuucucccuacaacucccgcuuugaaagcguugccugguccgcuucugccugccacgacggaauuaauuggcugaccaucggcaucagcgggccugauaacggagcuguggccguccucaaguauaauggcauuaucacagacaccauuaaguccuggagaaacaauauccugcggacacaagagagcgagugugcgugcgugaacgggucuuguuucaccgugaugacggauggaccguccgacggccaggccagcuacaaaauuuuucgcaucgaaaagggcaaaaucgucaagucuguugagaugaaugcucccaacuaucauuacgaagagugcagcuguuacccugauuccucugagauuacaugcgugugcagagacaauuggcacgggagcaaccggcccuggguguccuucaaucagaaccuugaauaucagaucggauacauuuguagcggcaucuuuggggauaauccucgccccaacgacaaaaccggaucuugcggcccggucuccagcaauggggccaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcugacaggacucgauuguauccgcccuugcuucuggguggaacugauuagaggccggcccaaagagaacacgaucuggaccagcggguccagcauuucuuuuuguggaguuaauuccgacacagugggcuggagcuggcccgauggggcugagcuuccuuucaccaucgacaaguga

SEQ ID NO: 204287 - RNA, 1410 nt, Artificial Sequence; identical to SEQ ID NO: 199762
  derived and/or modified sequence opt5 from neuraminidase__InfluenzaA__AEV53493

SEQ ID NO: 204288 - RNA, 1410 nt, Artificial Sequence; identical to SEQ ID NO: 201224
  derived and/or modified sequence opt5 from neuraminidase__InfluenzaA__AEV53495

SEQ ID NO: 204289 - RNA, 1410 nt, Artificial Sequence
  derived and/or modified sequence opt5 from neuraminidase__InfluenzaA__AEV53497
augaaccccaaucagaagaucauuaccaucggcagcgugugcaugacaauugggauggccaaccugauccuccaaauuggaaauaucaucuccauuuggaucucucacagcauucagcuggagaaccagaaucagaucgaaacguguaaccaauccgucauuaccuacgagaauaacacauggguuaaucagaccuaugugaacaucucuaauacaaacuucgcugccggccagagcguggucuccgugaaucuugcggggaacucuagccugugcccuguuuccggaugggcuauuuacagcaaagacaauucuaucagaaucggcuccaagggggauguguuugucauucgggaaccguucaucagcuguucuccccucgagugccgcaccuuuuuccugacacagggagcccuucugaacgacaaacauuccaacggcaccauuaaggauagaagcccuuaucggacgcucaugucuugucccaucggcgaagugccuucccccuacaauagccgcuuugaguccguugccuggucugcuagcgccugccacgacgggauuaacuggcugaccaucggaaucuccggcccugauaauggggcuguggccguccugaaauauaacggaauuaucacagacaccauuaagagcuggagaaauaacauccuccggacacaagagucugaaugugcgugcgugaauggcuccuguuucaccgugaugacggaugggccgagcgacggacaggccucuuacaagauuuuucgcaucgagaaaggcaagaucgucaaaagcguugaaaugaacgcucccaauuaucauuacgaggagugcuccuguuacccugauucuagcgaaauuacaugcgugugcagagacaacuggcacggcuccaaucggcccugggugagcuucaaccagaaucuggaguaucagaucggguacauuuguucuggaaucuuuggcgauaacccucgccccaaugacaagaccggguccugcggaccggucagcucuaacggcgccaacggggugaaaggauucuccuuuaaguauggcaauggcguuuggauugggagaacaaagagcaucuccucucggaacggauucgaaaugauuugggauccuaauggcuggaccgggaccgacaacaauuuuagcaucaaacaagacaucgugggaauuaacgagugguccggcuacucugggagcuucguccagcaucccgaacuuacaggccuggauuguauccgcccuugcuucuggguggagcucauuagaggacggcccaaggagaauacgaucuggaccuccggcagcucuauuuccuuuugugggguuaacagcgacacagugggauggucuuggcccgauggcgcugaacugccuuucaccaucgacaaauga

SEQ ID NO: 204290 - RNA, 1410 nt, Artificial Sequence; identical to SEQ ID NO: 200780
  derived and/or modified sequence opt5 from neuraminidase__InfluenzaA__AEV53499

SEQ ID NO: 204291 - RNA, 1410 nt, Artificial Sequence; identical to SEQ ID NO: 199762
  derived and/or modified sequence opt5 from neuraminidase__InfluenzaA__AEV53501

SEQ ID NO: 204292 - RNA, 1410 nt, Artificial Sequence; identical to SEQ ID NO: 199762
  derived and/or modified sequence opt5 from neuraminidase__InfluenzaA__AEV53503

SEQ ID NO: 204293 - RNA, 1410 nt, Artificial Sequence; identical to SEQ ID NO: 199762
  derived and/or modified sequence opt5 from neuraminidase__InfluenzaA__AEV53505

SEQ ID NO: 204294 - RNA, 1410 nt, Artificial Sequence; identical to SEQ ID NO: 199762
  derived and/or modified sequence opt5 from neuraminidase__InfluenzaA__AEV53507

SEQ ID NO: 204295 - RNA, 1410 nt, Artificial Sequence; identical to SEQ ID NO: 199762
  derived and/or modified sequence opt5 from neuraminidase__InfluenzaA__AEV53509

SEQ ID NO: 204296 - RNA, 1410 nt, Artificial Sequence; identical to SEQ ID NO: 201224
  derived and/or modified sequence opt5 from neuraminidase__InfluenzaA__AEV53511

SEQ ID NO: 204297 - RNA, 1410 nt, Artificial Sequence; identical to SEQ ID NO: 201224
  derived and/or modified sequence opt5 from neuraminidase__InfluenzaA__AEV53513

SEQ ID NO: 204298 - RNA, 1410 nt, Artificial Sequence; identical to SEQ ID NO: 201224
  derived and/or modified sequence opt5 from neuraminidase__InfluenzaA__AEV53515

SEQ ID NO: 204299 - RNA, 1410 nt, Artificial Sequence
  derived and/or modified sequence opt5 from neuraminidase__InfluenzaA__AEV53517
augaaccccaaucagagaaucauuaccaucggcagcgugugcaugacaauugggauggccaaccugauccuccaaauuggaaauaucaucuccauuugggucucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauucggaucggguccaagggagaugucuuugugauccgcgagccguucauuagcuguucuccccucgaaugcagaaccuuuuuccugacacagggcgcccuucugaaugacaaacauuccaacggcaccaucaaggaucggagcccuuaucgcacgcucaugucuugucccauuggggagguuccuucccccuacaacagcagauuugaauccguggccuggucugcuagcgccugccacgacggaaucaauuggcugaccauuggcaucuccgggccugauaacggagcugucgccgugcugaaauauaauggcaucauuacagacaccaucaagagcuggcggaacaauauucuccgcacacaagagucugagugugcgugcgugaacggguccuguuucaccgucaugacggauggaccgagcgacggccaggccucuuacaagaucuuuagaauugaaaaaggcaagaucguuaaaagcguggagaugaaugcucccaacuaucauuacgaagagugcuccuguuacccugauucuagcgagaucacaugcgugugccgggacaauuggcacggguccaaccgccccugggucagcuucaaucagaaccuggaauaucagauuggauacaucuguucuggcauuuuuggggauaauccuagacccaacgacaagaccggauccugcggcccggugagcucuaauggggccaacggaguuaaaggcuucuccuuuaaguauggcaacgggguguggaucggacggacaaagagcauuuccucucgcaauggcuucgagaugaucugggauccuaacggguggaccggaaccgacaauaacuuuagcauuaaacaagacaucgucggcaucaaugaaugguccggguacucuggcagcuucgugcagcaucccgagcuuacaggacuggauuguauuagaccuugcuucuggguugaacucauccggggccgccccaaggagaacacgauuuggaccuccgggagcucuaucuccuuuuguggagugaauagcgacacagucggcuggucuuggcccgauggggcugagcugccuuucaccauugacaaauga

SEQ ID NO: 204300 - RNA, 1410 nt, Artificial Sequence; identical to SEQ ID NO: 199762
  derived and/or modified sequence opt5 from neuraminidase__InfluenzaA__AEV53519

SEQ ID NO: 204301 - RNA, 1410 nt, Artificial Sequence; identical to SEQ ID NO: 201224
  derived and/or modified sequence opt5 from neuraminidase__InfluenzaA__AEV53521

SEQ ID NO: 204302 - RNA, 1410 nt, Artificial Sequence; identical to SEQ ID NO: 201050
  derived and/or modified sequence opt5 from neuraminidase__InfluenzaA__AEV53523

SEQ ID NO: 204303 - RNA, 1410 nt, Artificial Sequence; identical to SEQ ID NO: 200116
  derived and/or modified sequence opt5 from neuraminidase__InfluenzaA__AEV53525

SEQ ID NO: 204304 - RNA, 1410 nt, Artificial Sequence; identical to SEQ ID NO: 199762
  derived and/or modified sequence opt5 from neuraminidase__InfluenzaA__AEV53527

SEQ ID NO: 204305 - RNA, 1410 nt, Artificial Sequence
  derived and/or modified sequence opt5 from neuraminidase__InfluenzaA__AEV53529
augaaccccaaucagaagaucauuaccaucggcagcgugugcaugacaauugggauggccaaccugauccuccaaauuggaaauaucaucuccauuuggaucucucacagcauucagcuggagaaccagaaucagaucgaaacguguaaccaauccgucauuaccuacgagaauaacacauggguuaaucagaccuaugugaacaucucuaauacaaacuucgcugccggccagagcguggucuccgugaaacuugcgggaaauucuagccugugcccuguuuccgggugggcuauuuacagcaaggacaacucuaucagaaucggcuccaaaggggauguguuugucauucgggaaccguucaucagcuguucuccccucgagugccgcaccuuuuuccugacacagggagcccuucugaaugacaagcauuccaacggcaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcgugaacggcuccuguuucaccgugaugacggaugggccgagcgacggacaggccucuuacaaaauuuuucgcaucgagaagggcaaaaucgucaagagcguugaaaugaaugcucccaacuaucauuacgaggagugcuccuguuacccugauucuagcgaaauuacaugcgugugcagagacaauuggcacggcuccaaccggcccugggugagcuucaaucagaaccuggaguaucagaucggguacauuuguucuggaaucuuuggcgauaauccucgccccaacgacaaaaccggguccugcggaccggucagcucuaauggcgccaacggggugaagggauucuccuuuaaguauggcaacggcguuuggauugggagaacaaaaagcaucuccucucggaauggauucgaaaugauuugggauccuaacggcuggaccgggaccgacaauaacuuuagcaucaagcaagacaucgugggaauuaaagagugguccggcuacucugggagcuucguccagcaucccgaacuuacaggccuggauuguauccgcccuugcuucuggguggagcucauuagaggacggcccaaggagaauacgaucuggaccuccggcagcucuauuuccuuuugugggguuaacagcgacacagugggauggucuuggcccgauggcgcugaacugccuuucaccaucgacaaauga

SEQ ID NO: 204306 - RNA, 1410 nt, Artificial Sequence; identical to SEQ ID NO: 201224
  derived and/or modified sequence opt5 from neuraminidase__InfluenzaA__AEV53531

SEQ ID NO: 204307 - RNA, 1410 nt, Artificial Sequence
  derived and/or modified sequence opt5 from neuraminidase__InfluenzaA__AEV53533
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacugaacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 204308 - RNA, 1410 nt, Artificial Sequence; identical to SEQ ID NO: 199762
  derived and/or modified sequence opt5 from neuraminidase__InfluenzaA__AEV53535

SEQ ID NO: 204309 - RNA, 1410 nt, Artificial Sequence; identical to SEQ ID NO: 204283
  derived and/or modified sequence opt5 from neuraminidase__InfluenzaA__AEV53537

SEQ ID NO: 204310 - RNA, 1410 nt, Artificial Sequence; identical to SEQ ID NO: 199762
  derived and/or modified sequence opt5 from neuraminidase__InfluenzaA__AEV53539

SEQ ID NO: 204311 - RNA, 1410 nt, Artificial Sequence; identical to SEQ ID NO: 203201
  derived and/or modified sequence opt5 from neuraminidase__InfluenzaA__AEV53541

SEQ ID NO: 204312 - RNA, 1410 nt, Artificial Sequence; identical to SEQ ID NO: 203201
  derived and/or modified sequence opt5 from neuraminidase__InfluenzaA__AEV53543

SEQ ID NO: 204313 - RNA, 1410 nt, Artificial Sequence; identical to SEQ ID NO: 201410
  derived and/or modified sequence opt5 from neuraminidase__InfluenzaA__AEV53545

SEQ ID NO: 204314 - RNA, 1410 nt, Artificial Sequence; identical to SEQ ID NO: 203201
  derived and/or modified sequence opt5 from neuraminidase__InfluenzaA__AEV53547

SEQ ID NO: 204315 - RNA, 1410 nt, Artificial Sequence; identical to SEQ ID NO: 203201
  derived and/or modified sequence opt5 from neuraminidase__InfluenzaA__AEV53549

SEQ ID NO: 204316 - RNA, 1410 nt, Artificial Sequence; identical to SEQ ID NO: 203201
  derived and/or modified sequence opt5 from neuraminidase__InfluenzaA__AEV53551

SEQ ID NO: 204317 - RNA, 1410 nt, Artificial Sequence; identical to SEQ ID NO: 203201
  derived and/or modified sequence opt5 from neuraminidase__InfluenzaA__AEV53553

SEQ ID NO: 204318 - RNA, 1410 nt, Artificial Sequence; identical to SEQ ID NO: 204283
  derived and/or modified sequence opt5 from neuraminidase__InfluenzaA__AEV53555

SEQ ID NO: 204319 - RNA, 1410 nt, Artificial Sequence; identical to SEQ ID NO: 200780
  derived and/or modified sequence opt5 from neuraminidase__InfluenzaA__AEV53557

SEQ ID NO: 204320 - RNA, 1410 nt, Artificial Sequence; identical to SEQ ID NO: 199762
  derived and/or modified sequence opt5 from neuraminidase__InfluenzaA__AEV53559

SEQ ID NO: 204321 - RNA, 1410 nt, Artificial Sequence; identical to SEQ ID NO: 199762
  derived and/or modified sequence opt5 from neuraminidase__InfluenzaA__AEV53561

SEQ ID NO: 204322 - RNA, 1410 nt, Artificial Sequence; identical to SEQ ID NO: 201354
  derived and/or modified sequence opt5 from neuraminidase__InfluenzaA__AEV53563

SEQ ID NO: 204323 - RNA, 1410 nt, Artificial Sequence
  derived and/or modified sequence opt5 from neuraminidase__InfluenzaA__AEV53565
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccucuuaccaucgacaaguga

SEQ ID NO: 204324 - RNA, 1410 nt, Artificial Sequence
  derived and/or modified sequence opt5 from neuraminidase__InfluenzaA__AEV53567
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacggggcuuggauuggaagaacaaaaagcaucuccucucggaauggcuucgagaugauuugggauccuaacggguggaccgaaaccgacaauaacuuuagcaucaagcaagacaucguuggaauuaaugagugguccggcuacucugggagcuucgugcagcaucccgaacuuacaggccugaacuguauccgcccuugcuucugggucgagcucauuagaggacggcccaaagagaauacgaucuggaccuccggcagcucuauuuccuuuuguggggugaacagcgauacaguuggauggucuuggcccgacggcgccgaacugccuuucaccaucgauaaguga

SEQ ID NO: 204325 - RNA, 1410 nt, Artificial Sequence; identical to SEQ ID NO: 199762
  derived and/or modified sequence opt5 from neuraminidase__InfluenzaA__AEV53569

SEQ ID NO: 204326 - RNA, 1410 nt, Artificial Sequence; identical to SEQ ID NO: 203201
  derived and/or modified sequence opt5 from neuraminidase__InfluenzaA__AEV53571

SEQ ID NO: 204327 - RNA, 1410 nt, Artificial Sequence; identical to SEQ ID NO: 203201
  derived and/or modified sequence opt5 from neuraminidase__InfluenzaA__AEV53573

SEQ ID NO: 204328 - RNA, 1410 nt, Artificial Sequence; identical to SEQ ID NO: 201563
  derived and/or modified sequence opt5 from neuraminidase__InfluenzaA__AEV53575

SEQ ID NO: 204329 - RNA, 1410 nt, Artificial Sequence
  derived and/or modified sequence opt5 from neuraminidase__InfluenzaA__AEV53577
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcagcccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 204330 - RNA, 1410 nt, Artificial Sequence; identical to SEQ ID NO: 204268
  derived and/or modified sequence opt5 from neuraminidase__InfluenzaA__AEV53579

SEQ ID NO: 204331 - RNA, 1410 nt, Artificial Sequence; identical to SEQ ID NO: 201563
  derived and/or modified sequence opt5 from neuraminidase__InfluenzaA__AEV53581

SEQ ID NO: 204332 - RNA, 1410 nt, Artificial Sequence; identical to SEQ ID NO: 201224
  derived and/or modified sequence opt5 from neuraminidase__InfluenzaA__AEV53583

SEQ ID NO: 204333 - RNA, 1410 nt, Artificial Sequence; identical to SEQ ID NO: 201224
  derived and/or modified sequence opt5 from neuraminidase__InfluenzaA__AEV53585

SEQ ID NO: 204334 - RNA, 1410 nt, Artificial Sequence
  derived and/or modified sequence opt5 from neuraminidase__InfluenzaA__AEV76877
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcacaaccaacuucgcugccgggcaguccguggucucugugaaacuugcgggaaauagcucccugugcccuguuagcggcugggcuauuuacucuaaggacaacuccaucagaaucgggagcaaaggagauguguuugucauucgggagccguucaucucuuguagcccccucgaaugccgcacauuuuuccugacccagggcgcccuucugaaugacaagcauuccaacggcacgauuaaagauagaucuccuuaucggacccucauguccugucccaucggggaggugccuagccccuacaauucccgcuuugaaucuguugccuggagcgcuuccgccugccacgacggaauuaacuggcugacaaucggcaucagcgggccugauaacggagcuguggccguccugaaguauaauggcauuaucaccgacacaauuaagucuuggagaaacaauauccuccggacccaagaguccgagugugcgugcgugaacgggagcuguuucacgauuaugacagauggaccgucugacggccaggccagcuacaaaaucuuucgcaucgaaaagggcaaaauugugaaguccgucgagaugaaugcucccaacuaucauuacgaagagugcucuuguuacccugauagcuccgagauuaccugcguuugcagagacaauuggcacgggagcaaccggcccugggugucuuucaaucagaaccuggaauaucagaucggauacaucuguuccggcauuuuuggggauaauccucgccccaacgacaaaacaggaagcugcggcccggugucuuccaauggggccaacggagucaagggcuucagcuuuaaguauggcaaugggguguggaucggaagaaccaaauccauuucuagccggaagggcuucgagaugaucugggauccuaacggguggaccggaacagacaacaauuuuuccaucaaacaagacauuguuggcaucaacgaauggucuggguacagcggcuccuucgugcagcaucccgagcuuacgggacuggauuguauucgcccuugcuucugggucgaacucaucagaggccggcccaaggagaauaccauuuggacaagcgggucuuccaucagcuuuuguggagugaacucugacaccguuggcugguccuggcccgauggggcugagcugccuuucacaaucgacaaauga

SEQ ID NO: 204335 - RNA, 1410 nt, Artificial Sequence; identical to SEQ ID NO: 199762
  derived and/or modified sequence opt5 from neuraminidase__InfluenzaA__AEW10576

SEQ ID NO: 204336 - RNA, 1410 nt, Artificial Sequence; identical to SEQ ID NO: 199762
  derived and/or modified sequence opt5 from neuraminidase__InfluenzaA__AEW10586

SEQ ID NO: 204337 - RNA, 1410 nt, Artificial Sequence; identical to SEQ ID NO: 199762
  derived and/or modified sequence opt5 from neuraminidase__InfluenzaA__AEW10596

SEQ ID NO: 204338 - RNA, 1410 nt, Artificial Sequence; identical to SEQ ID NO: 199762
  derived and/or modified sequence opt5 from neuraminidase__InfluenzaA__AEW10606

SEQ ID NO: 204339 - RNA, 1410 nt, Artificial Sequence; identical to SEQ ID NO: 200649
  derived and/or modified sequence opt5 from neuraminidase__InfluenzaA__AEW10616

SEQ ID NO: 204340 - RNA, 1410 nt, Artificial Sequence
  derived and/or modified sequence opt5 from neuraminidase__InfluenzaA__AEW10626
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuauggccgugcugaaguauaauggcauuaucacagacaccauuaagagcuggagaaacaauauccuccggacacaagagucugagugugcgugcgucaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggcugagcugccuuucaccaucgacaaguga

SEQ ID NO: 204341 - RNA, 1410 nt, Artificial Sequence; identical to SEQ ID NO: 199762
  derived and/or modified sequence opt5 from neuraminidase__InfluenzaA__AEW10636

SEQ ID NO: 204342 - RNA, 1410 nt, Artificial Sequence; identical to SEQ ID NO: 199752
  derived and/or modified sequence opt5 from neuraminidase__InfluenzaA__AEW10646

SEQ ID NO: 204343 - RNA, 1410 nt, Artificial Sequence; identical to SEQ ID NO: 199762
  derived and/or modified sequence opt5 from neuraminidase__InfluenzaA__AEW10656

SEQ ID NO: 204344 - RNA, 1410 nt, Artificial Sequence; identical to SEQ ID NO: 199762
  derived and/or modified sequence opt5 from neuraminidase__InfluenzaA__AEW10666

SEQ ID NO: 204345 - RNA, 1410 nt, Artificial Sequence; identical to SEQ ID NO: 199762
  derived and/or modified sequence opt5 from neuraminidase__InfluenzaA__AEW10676

SEQ ID NO: 204346 - RNA, 1410 nt, Artificial Sequence; identical to SEQ ID NO: 199762
  derived and/or modified sequence opt5 from neuraminidase__InfluenzaA__AEW10686

SEQ ID NO: 204347 - RNA, 1410 nt, Artificial Sequence; identical to SEQ ID NO: 199762
  derived and/or modified sequence opt5 from neuraminidase__InfluenzaA__AEW10696

SEQ ID NO: 204348 - RNA, 1410 nt, Artificial Sequence; identical to SEQ ID NO: 199762
  derived and/or modified sequence opt5 from neuraminidase__InfluenzaA__AEW10706

SEQ ID NO: 204349 - RNA, 1410 nt, Artificial Sequence; identical to SEQ ID NO: 199752
  derived and/or modified sequence opt5 from neuraminidase__InfluenzaA__AEW10716

SEQ ID NO: 204350 - RNA, 1410 nt, Artificial Sequence; identical to SEQ ID NO: 199762
  derived and/or modified sequence opt5 from neuraminidase__InfluenzaA__AEW10726

SEQ ID NO: 204351 - RNA, 1410 nt, Artificial Sequence; identical to SEQ ID NO: 199762
  derived and/or modified sequence opt5 from neuraminidase__InfluenzaA__AEW10736

SEQ ID NO: 204352 - RNA, 1410 nt, Artificial Sequence; identical to SEQ ID NO: 199752
  derived and/or modified sequence opt5 from neuraminidase__InfluenzaA__AEW10746

SEQ ID NO: 204353 - RNA, 1410 nt, Artificial Sequence; identical to SEQ ID NO: 199752
  derived and/or modified sequence opt5 from neuraminidase__InfluenzaA__AEW10756

SEQ ID NO: 204354 - RNA, 1410 nt, Artificial Sequence; identical to SEQ ID NO: 199752
  derived and/or modified sequence opt5 from neuraminidase__InfluenzaA__AEW10766

SEQ ID NO: 204355 - RNA, 1410 nt, Artificial Sequence; identical to SEQ ID NO: 199752
  derived and/or modified sequence opt5 from neuraminidase__InfluenzaA__AEW10776

SEQ ID NO: 204356 - RNA, 1410 nt, Artificial Sequence; identical to SEQ ID NO: 199752
  derived and/or modified sequence opt5 from neuraminidase__InfluenzaA__AEW10786

SEQ ID NO: 204357 - RNA, 1410 nt, Artificial Sequence; identical to SEQ ID NO: 199752
  derived and/or modified sequence opt5 from neuraminidase__InfluenzaA__AEW10796

SEQ ID NO: 204358 - RNA, 1410 nt, Artificial Sequence; identical to SEQ ID NO: 199752
  derived and/or modified sequence opt5 from neuraminidase__InfluenzaA__AEW10806

SEQ ID NO: 204359 - RNA, 1410 nt, Artificial Sequence; identical to SEQ ID NO: 199752
  derived and/or modified sequence opt5 from neuraminidase__InfluenzaA__AEW10816

SEQ ID NO: 204360 - RNA, 1410 nt, Artificial Sequence; identical to SEQ ID NO: 199762
  derived and/or modified sequence opt5 from neuraminidase__InfluenzaA__AEW10826

SEQ ID NO: 204361 - RNA, 1410 nt, Artificial Sequence; identical to SEQ ID NO: 199752
  derived and/or modified sequence opt5 from neuraminidase__InfluenzaA__AEW10836

SEQ ID NO: 204362 - RNA, 1410 nt, Artificial Sequence; identical to SEQ ID NO: 199752
  derived and/or modified sequence opt5 from neuraminidase__InfluenzaA__AEW10846

SEQ ID NO: 204363 - RNA, 1410 nt, Artificial Sequence; identical to SEQ ID NO: 199752
  derived and/or modified sequence opt5 from neuraminidase__InfluenzaA__AEW10856

SEQ ID NO: 204364 - RNA, 1410 nt, Artificial Sequence; identical to SEQ ID NO: 199752
  derived and/or modified sequence opt5 from neuraminidase__InfluenzaA__AEW10866

SEQ ID NO: 204365 - RNA, 1410 nt, Artificial Sequence; identical to SEQ ID NO: 199752
  derived and/or modified sequence opt5 from neuraminidase__InfluenzaA__AEW10876

SEQ ID NO: 204366 - RNA, 1410 nt, Artificial Sequence; identical to SEQ ID NO: 199752
  derived and/or modified sequence opt5 from neuraminidase__InfluenzaA__AEW10886

SEQ ID NO: 204367 - RNA, 1410 nt, Artificial Sequence; identical to SEQ ID NO: 199752
  derived and/or modified sequence opt5 from neuraminidase__InfluenzaA__AEW10896

SEQ ID NO: 204368 - RNA, 1410 nt, Artificial Sequence; identical to SEQ ID NO: 199752
  derived and/or modified sequence opt5 from neuraminidase__InfluenzaA__AEW10906

SEQ ID NO: 204369 - RNA, 1410 nt, Artificial Sequence; identical to SEQ ID NO: 199752
  derived and/or modified sequence opt5 from neuraminidase__InfluenzaA__AEW10916

SEQ ID NO: 204370 - RNA, 1410 nt, Artificial Sequence
  derived and/or modified sequence opt5 from neuraminidase__InfluenzaA__AEW10926
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuuauuauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 204371 - RNA, 1410 nt, Artificial Sequence; identical to SEQ ID NO: 199752
  derived and/or modified sequence opt5 from neuraminidase__InfluenzaA__AEW10936

SEQ ID NO: 204372 - RNA, 1410 nt, Artificial Sequence; identical to SEQ ID NO: 199752
  derived and/or modified sequence opt5 from neuraminidase__InfluenzaA__AEW10946

SEQ ID NO: 204373 - RNA, 1410 nt, Artificial Sequence; identical to SEQ ID NO: 199762
  derived and/or modified sequence opt5 from neuraminidase__InfluenzaA__AEW10956

SEQ ID NO: 204374 - RNA, 1410 nt, Artificial Sequence; identical to SEQ ID NO: 199762
  derived and/or modified sequence opt5 from neuraminidase__InfluenzaA__AEW10966

SEQ ID NO: 204375 - RNA, 1410 nt, Artificial Sequence; identical to SEQ ID NO: 199752
  derived and/or modified sequence opt5 from neuraminidase__InfluenzaA__AEW10976

SEQ ID NO: 204376 - RNA, 1410 nt, Artificial Sequence; identical to SEQ ID NO: 199762
  derived and/or modified sequence opt5 from neuraminidase__InfluenzaA__AEW10986

SEQ ID NO: 204377 - RNA, 1410 nt, Artificial Sequence; identical to SEQ ID NO: 199762
  derived and/or modified sequence opt5 from neuraminidase__InfluenzaA__AEW10996

SEQ ID NO: 204378 - RNA, 1410 nt, Artificial Sequence; identical to SEQ ID NO: 199762
  derived and/or modified sequence opt5 from neuraminidase__InfluenzaA__AEW11006

SEQ ID NO: 204379 - RNA, 1410 nt, Artificial Sequence; identical to SEQ ID NO: 199762
  derived and/or modified sequence opt5 from neuraminidase__InfluenzaA__AEW11016

SEQ ID NO: 204380 - RNA, 1410 nt, Artificial Sequence; identical to SEQ ID NO: 199762
  derived and/or modified sequence opt5 from neuraminidase__InfluenzaA__AEW11026

SEQ ID NO: 204381 - RNA, 1410 nt, Artificial Sequence; identical to SEQ ID NO: 199762
  derived and/or modified sequence opt5 from neuraminidase__InfluenzaA__AEW11036

SEQ ID NO: 204382 - RNA, 1410 nt, Artificial Sequence; identical to SEQ ID NO: 199752
  derived and/or modified sequence opt5 from neuraminidase__InfluenzaA__AEW11046

SEQ ID NO: 204383 - RNA, 1410 nt, Artificial Sequence; identical to SEQ ID NO: 199762
  derived and/or modified sequence opt5 from neuraminidase__InfluenzaA__AEW11056

SEQ ID NO: 204384 - RNA, 1410 nt, Artificial Sequence; identical to SEQ ID NO: 200566
  derived and/or modified sequence opt5 from neuraminidase__InfluenzaA__AEW11066

SEQ ID NO: 204385 - RNA, 1410 nt, Artificial Sequence; identical to SEQ ID NO: 200566
  derived and/or modified sequence opt5 from neuraminidase__InfluenzaA__AEW11076

SEQ ID NO: 204386 - RNA, 1410 nt, Artificial Sequence; identical to SEQ ID NO: 200566
  derived and/or modified sequence opt5 from neuraminidase__InfluenzaA__AEW11086

SEQ ID NO: 204387 - RNA, 1410 nt, Artificial Sequence; identical to SEQ ID NO: 200566
  derived and/or modified sequence opt5 from neuraminidase__InfluenzaA__AEW11096

SEQ ID NO: 204388 - RNA, 1410 nt, Artificial Sequence; identical to SEQ ID NO: 200566
  derived and/or modified sequence opt5 from neuraminidase__InfluenzaA__AEW11106

SEQ ID NO: 204389 - RNA, 1410 nt, Artificial Sequence; identical to SEQ ID NO: 199762
  derived and/or modified sequence opt5 from neuraminidase__InfluenzaA__AEW11116

SEQ ID NO: 204390 - RNA, 1410 nt, Artificial Sequence; identical to SEQ ID NO: 200566
  derived and/or modified sequence opt5 from neuraminidase__InfluenzaA__AEW11126

SEQ ID NO: 204391 - RNA, 1410 nt, Artificial Sequence; identical to SEQ ID NO: 200470
  derived and/or modified sequence opt5 from neuraminidase__InfluenzaA__AEW11136

SEQ ID NO: 204392 - RNA, 1410 nt, Artificial Sequence; identical to SEQ ID NO: 199762
  derived and/or modified sequence opt5 from neuraminidase__InfluenzaA__AEW11146

SEQ ID NO: 204393 - RNA, 1410 nt, Artificial Sequence; identical to SEQ ID NO: 199762
  derived and/or modified sequence opt5 from neuraminidase__InfluenzaA__AEW11156

SEQ ID NO: 204394 - RNA, 1410 nt, Artificial Sequence; identical to SEQ ID NO: 200566
  derived and/or modified sequence opt5 from neuraminidase__InfluenzaA__AEW11166

SEQ ID NO: 204395 - RNA, 1410 nt, Artificial Sequence; identical to SEQ ID NO: 200566
  derived and/or modified sequence opt5 from neuraminidase__InfluenzaA__AEW11176

SEQ ID NO: 204396 - RNA, 1410 nt, Artificial Sequence; identical to SEQ ID NO: 199762
  derived and/or modified sequence opt5 from neuraminidase__InfluenzaA__AEW11186

SEQ ID NO: 204397 - RNA, 1410 nt, Artificial Sequence; identical to SEQ ID NO: 200566
  derived and/or modified sequence opt5 from neuraminidase__InfluenzaA__AEW11196

SEQ ID NO: 204398 - RNA, 1410 nt, Artificial Sequence; identical to SEQ ID NO: 199762
  derived and/or modified sequence opt5 from neuraminidase__InfluenzaA__AEW11206

SEQ ID NO: 204399 - RNA, 1410 nt, Artificial Sequence; identical to SEQ ID NO: 199762
  derived and/or modified sequence opt5 from neuraminidase__InfluenzaA__AEW11216

SEQ ID NO: 204400 - RNA, 1410 nt, Artificial Sequence; identical to SEQ ID NO: 200470
  derived and/or modified sequence opt5 from neuraminidase__InfluenzaA__AEW11226

SEQ ID NO: 204401 - RNA, 1410 nt, Artificial Sequence; identical to SEQ ID NO: 199762
  derived and/or modified sequence opt5 from neuraminidase__InfluenzaA__AEW11236

SEQ ID NO: 204402 - RNA, 1410 nt, Artificial Sequence; identical to SEQ ID NO: 199762
  derived and/or modified sequence opt5 from neuraminidase__InfluenzaA__AEW11246

SEQ ID NO: 204403 - RNA, 1410 nt, Artificial Sequence; identical to SEQ ID NO: 200566
  derived and/or modified sequence opt5 from neuraminidase__InfluenzaA__AEW11255

SEQ ID NO: 204404 - RNA, 1410 nt, Artificial Sequence; identical to SEQ ID NO: 200566
  derived and/or modified sequence opt5 from neuraminidase__InfluenzaA__AEW11265

SEQ ID NO: 204405 - RNA, 1410 nt, Artificial Sequence; identical to SEQ ID NO: 199762
  derived and/or modified sequence opt5 from neuraminidase__InfluenzaA__AEW11275

SEQ ID NO: 204406 - RNA, 1410 nt, Artificial Sequence
  derived and/or modified sequence opt5 from neuraminidase__InfluenzaA__AEW11285
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuuuaaguauggcaaugggguguggaucggaagaacaaaaagcauuuccucucggaacggcuucgagaugaucugggacccuaauggguggaccggaaccgauaacaauuuuagcauuaagcaagacaucgucggcaucaacgaaugguccggguacucuggcagcuucgugcagaaucccgagcuuacaggacuggacuguauucgcccuugcuucuggguugaacucaucagaggccggcccaaagagaacacgauuuggaccuccgggagcucuaucuccuuuuguggagugaauagcgauacagucggcuggucuuggcccgacggggcugagcugccuuucaccauugauaaguga

SEQ ID NO: 204407 - RNA, 1410 nt, Artificial Sequence; identical to SEQ ID NO: 200566
  derived and/or modified sequence opt5 from neuraminidase__InfluenzaA__AEW11295

SEQ ID NO: 204408 - RNA, 1410 nt, Artificial Sequence; identical to SEQ ID NO: 199762
  derived and/or modified sequence opt5 from neuraminidase__InfluenzaA__AEW11305

SEQ ID NO: 204409 - RNA, 1410 nt, Artificial Sequence; identical to SEQ ID NO: 200566
  derived and/or modified sequence opt5 from neuraminidase__InfluenzaA__AEW11315

SEQ ID NO: 204410 - RNA, 1410 nt, Artificial Sequence; identical to SEQ ID NO: 199762
  derived and/or modified sequence opt5 from neuraminidase__InfluenzaA__AEW11325

SEQ ID NO: 204411 - RNA, 1410 nt, Artificial Sequence; identical to SEQ ID NO: 199762
  derived and/or modified sequence opt5 from neuraminidase__InfluenzaA__AEW25299

SEQ ID NO: 204412 - RNA, 1410 nt, Artificial Sequence; identical to SEQ ID NO: 199762
  derived and/or modified sequence opt5 from neuraminidase__InfluenzaA__AEW25308

SEQ ID NO: 204413 - RNA, 1410 nt, Artificial Sequence; identical to SEQ ID NO: 200835
  derived and/or modified sequence opt5 from neuraminidase__InfluenzaA__AEW25317

SEQ ID NO: 204414 - RNA, 1410 nt, Artificial Sequence; identical to SEQ ID NO: 199762
  derived and/or modified sequence opt5 from neuraminidase__InfluenzaA__AEW25324

SEQ ID NO: 204415 - RNA, 1410 nt, Artificial Sequence
  derived and/or modified sequence opt5 from neuraminidase__InfluenzaA__AEW25327
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccucccccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccgugaugacggauggacccuccgacggccaggccagcuacaaaauuuuucgcaucgaaaagggcaaaaucgucaagucuguugagaugaaugcuccuaacuaucauugcgaagaguguagcugcuaccccgauuccucugagauuacaugcguguguagagacaauuggcacgggagcaaccggccuuggguguccuucaaucagaaccuggaauaccagaucggauauauuugcagcggcaucuuuggggauaauccccgcccgaacgacaaaaccggaucuuguggcccugucuccagcaauggggccaacggagugaagggcuucucuuuuaaguacggcaacgggguuuggauuggaagaacaaaauccaucagcucccggaauggcuucgagaugauuugggaucccaacggguggaccggaaccgacaauaacuuuucuaucaagcaagacaucgugggcauuaaugaauggagcggguauuccggcucuuucguccagcauccugagcuuacaggacuggauugcauccgccccuguuucuggguggaacucauuagaggccggcccaaagagaacacgaucuggaccagcggguccagcauuucuuuuugcggaguuaauuccgacacagugggcuggagcuggccugauggggcugagcugccguucaccaucgacaaguga

SEQ ID NO: 204416 - RNA, 1410 nt, Artificial Sequence
  derived and/or modified sequence opt5 from neuraminidase__InfluenzaA__AEW25333
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucauaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaucggacgcucaugucuugucccaucggggaggugccuucccccuacaacagccgcuuugaauccguugccuggucugcuagcgccugccaugacggaauuaauuggcugaccaucggcaucuccgggccugauaacggagcuguggccguccugaaguauaauggcauuaucacagacaccauuaagagcuggagaaacaauauccuccggacacaggagucugagugugcgugcgugaacggguccuguuucaccgugaugacggauggaccgagcgacggccaagccucuuacaaaauuuuucgcaucgaaaagggcaaaaucgucaagagcguugagaugaaugcucccaacuaucacuacgaagagugcuccuguuacccugauucuagcgagauuacaugcgugugcagagacaauuggcauggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuugggugggaagaacaaaaagcauuuccucucggaauggcuucgagaugaucugggauccuaacggguggaccggaaccgacaauaacuuuagcauuaagcaggacaucgucggcaucaaugaaugguccggguacucuggcagcuucgugcaacaccccgagcuuacaggacuggauuguauucgccacugcuucuggguugaacucaucagaggccggccuaaagagaacacgauuuggaccuccgggagcucuaucuccuuuuguggagugaauagcgacacagucggcuggucuuggcccgauggggcugagcugcccuucaccauugacaaguga

SEQ ID NO: 204417 - RNA, 1410 nt, Artificial Sequence
  derived and/or modified sequence opt5 from neuraminidase__InfluenzaA__AEW25338
augaaccccaaucagaagaucauuaccaucggcagcgugugcauggccauugggauggcuaaccugauccuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgccgcggggcagagcguggucuccgugaaacuugcuggaaauucuagccugugcccuguuuccggcugggccauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugcuuggucugccagcgcuugccacgacggaauuaauuggcugacgaucggcaucuccgggccugauaacggagccguggcgguccugaaguauaauggcauuaucaccgacacaauuaagagcuggagaaacaauauccuccggacccaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucagaucggauacauucgcucuggcaucuuuggggauaauccuagacccaacgacaaaacaggauccuguggcccggucagcucuaauggggcuaacggagugaagggcuucuccuuuaaguauggcaacgggguuuggauuggacggaccaaaagcaucuccucucgcaauggcuucgagaugauuugggauccuaacggguggacaggaaccgacaauaacuuuagcaucaagcaagacaucgugggcauuaaugaaugguccggguacucuggcagcuucguccagcaucccgagcuuaccggacuggauugcaucagaccuuguuucuggguggaacucauucggggccgccccaaagagaacacaaucuggacguccgggagcucuauuuccuuuugcggaguuaauagcgacaccgugggcuggucuuggcccgauggggccgagcugccuuucacaaucgacaaguga

SEQ ID NO: 204418 - RNA, 1410 nt, Artificial Sequence
  derived and/or modified sequence opt5 from neuraminidase__InfluenzaA__AEW25343
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuccgaaucuguugccuggagcgcuuccgccugccacgacggaauuaauuggcugaccaucggcaucagcgggccugauaacggagcuguggccguccugaaguauaauggcauuaucacagacaccauuaagucuuggagaaacaauauccuccggacacaagaguccgugugugcgugcgugaacgggagcuguuuuaccgucaugacggauggaccgucugacggccaggccagcuacaaaauuuuccgcaucgagaagggcaaaaucguuaaguccguggaaaugaaugcucccaacuaucauuacgaggaaugcucuuguuacccugauagcuccgagauuacaugcgugugcagagacaauuggcacgggagcaaccggcccugggucucuuuuaaucagaaccuggaguaucagaucggauacauuuguuccggcaucuucggggauagcccucgccccaaugacaaaaccggaucuugcggcccgguguccagcaacggggccaauggaguuaagggcuuuuccuucaaguauggcaacgggguguggauuggaagaacaaaaucuaucagcucccggaacggcuuugaaaugauuugggauccuaauggguggaccggaaccgacaacaauuucucuaucaagcaagacaucgucggcauuaacgaguggagcggguacuccggcagcuuugugcagcaucccgaacuuacaggacuggauuguauccgcccuugcuucuggguugagcucauuagaggccggcccaaagaaaauacgaucuggaccucuggguccagcauuucuuucuguggagugaacuccgacacagucggcuggagcuggcccgauggggcugagcugccuuuuaccaucgacaaguga

SEQ ID NO: 204419 - RNA, 1410 nt, Artificial Sequence
  derived and/or modified sequence opt5 from neuraminidase__InfluenzaA__AEW25351
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucauaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaacgauagaagcccuuaucggacgcucaugucuugucccaucggggaggugccuucccccuacaauagccgcuuugaauccguugccuggucugcuagcgccugccaugacggaauuaacuggcugaccaucggcaucuccgggccugauaauggagcuguggccguccugaaauauaacggcauuaucacagacaccauuaagagcuggagaaauaacauccuccggacacaggagucugagugugcgugcgugaauggguccuguuucaccgugaugacggauggaccgagcgacggccaagccucuuacaagauuuuucgcaucgaaaaaggcaagaucgucaaaagcguugagaugaacgcucccaauuaucacuacgaagagugcuccuguuacccugauucuagcgagauuacaugcgugugcagagacaacuggcauggguccaaucggcccugggugagcuucaaccagaaucuggaauaucagaucggauacauuuguucuggcaccuuuggggauaacccucgccccaaugacaagacaggauccugcggcccggucagcucuaacggggccaacggagugaaaggcuucuccuuuaaguauggcaaugggguuuggaucggaagaaccaagagcauuuccucucggaacggcuucgagaugaucugggauccuaauggguggaccggaacagacaacaauuuuagcauuaaacaggacaucgugggcaucaacgaaugguccggguacucuggcagcuucguccaacaccccgagcuuacgggacuggauuguauucgcccuugcuucuggguggaacucaucagaggccggcccaaggagaauaccauuuggacauccgggagcucuaucuccuuuuguggaguuaacagcgacaccgugggcuggucuuggcccgauggggcugagcugccuuucacaauugacaaauga

SEQ ID NO: 204420 - RNA, 1410 nt, Artificial Sequence
  derived and/or modified sequence opt5 from neuraminidase__InfluenzaA__AEW25358
augaaccccaaucagaagaucauuaccaucggcagcgugugcaugacaauugggauggccaaccugauccuccaaauuggaaauaucaucuccauuugggucucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucaccagcuguucuccccucgaaugccgcacauuuuuccugacccagggcgcccuucugaaugacaagcauuccaacggcacgauuaaagauagaagcccuuaucggacccucaugucuugucccaucggggagguuccuucccccuacaacagccgcuuugaauccguggccuggucugcuagcgccugccacgacggaauuaauuggcugacaaucggcauuuccgggccugauaacggagcugucgccgugcugaaguauaauggcaucaucaccgacacaauuaagagcuggagaaacaauauccuccggacccaagagucugagugugcgugcgugaacggguccuguuucacggucaugacagauggaccgagcgacggccaggccucuuacaaaauuuuucgcaucgaaaagggcaaaauuguuaagagcguggagaugaaugcucccaacuaucauuacgaagagugcuccuguuacccugauucuagcgagauuaccugcgugugcagagacaauuggcacggguccaaccggcccugggucagcuucaaucagaaccuggaauaucagaucggauacaucuguucuggcaucuuuggggauaauccucgccccaacgacaaaacaggauccugcggcccggugagcucuaauggggccaacggaguuaagggcuucuccuuuaaguauggcaacgggguguggauuggaagaaccaaaagcaucuccucucggaauggcuucgagaugauuugggauccuaacggguggaccggaacagacaauaacuuuagcaucaagcaagacauugucggcaucaaugaaugguccggguacucuggcagcuucgugcagcaucccgagcuuacgggacuggauuguauccgcccuugcuucuggguugaacucauuagaggccggcccaaagagaacaccaucuggacauccgggagcucuauuuccuuuuguggagugaauagcgacaccgucggcuggucuuggcccgauggggcugagcugccuuucacaaucgugaaguga

SEQ ID NO: 204421 - RNA, 1410 nt, Artificial Sequence; identical to SEQ ID NO: 199762
  derived and/or modified sequence opt5 from neuraminidase__InfluenzaA__AEW25361

SEQ ID NO: 204422 - RNA, 1410 nt, Artificial Sequence
  derived and/or modified sequence opt5 from neuraminidase__InfluenzaA__AEW25379
augaaccccaaucagaagaucauuaccaucggcagcgugugcaugacaauugggauggccaaccugauccuccaaauuggaaauaucaucuccauuuggacgucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgaggugaccugcgugugcagagacaauuggcacggguccaaccggcccugggucagcuucaaucagaaccuggaauaucagaucggauacauuuguucuggcaucuuuggggauaauccucgccccaacgacaaaacaggauccugcggcccggugagcucugauggggccaauggaguuaagggcuucuccuuuaaguauggcaacgggguguggauuggaagaaccaaaagcaucuccucucggaacggcuucgagaugauuugggacccuaauggguggaccggaacagacaacaauuuuagcaucaagcaagauauugucggcaucaacgaaugguccggguacucuggcagcuucgugcagcaucccgagcuuacgggacuggacuguauccgcccuugcuucuggguugaacucauuagaggccggcccaaagagaauaccaucuggacauccgggagcucuauuuccuuuuguggagugaacagcgauaccgucggcuggucuuggcccgacggggcugagcugccuuucacaaucgauaaguga

SEQ ID NO: 204423 - RNA, 1410 nt, Artificial Sequence
  derived and/or modified sequence opt5 from neuraminidase__InfluenzaA__AEW25387
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcguggauggguccuguuucaccgugaugacggacggaccgagcgauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuugaggacaacccucgccccaaugauaaaaccggguccugcggaccggucagcucuaacggcgccaauggggugaagggauucuccuuuaaguauggcaacggcguuuggauugggagaacaaaaagcaucuccucucggaacggauucgaaaugauuugggacccuaauggcuggaccgggaccgacaacaauuuuagcaucaagcaagauaucgugggaauuaacgagugguccggcuacucugggagcuucguccagcaucccgaacuuacaggccuggacuguauccgcccuugcuucuggguggagcucauuagaggacggcccaaagagaauacgaucuggaccuccggcagcucuauuuccuuuugugggguuaacagcgauacagugggauggucuuggcccgacggcgcugaacugccuuucaccaucgauaaguga

SEQ ID NO: 204424 - RNA, 1410 nt, Artificial Sequence
  derived and/or modified sequence opt5 from neuraminidase__InfluenzaA__AEW25392
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaugacaucgugggcauuaaugaaugguccggguacucuggcagcuucguccaacaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 204425 - RNA, 1410 nt, Artificial Sequence
  derived and/or modified sequence opt5 from neuraminidase__InfluenzaA__AEW25397
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaaccuguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccgugaugacggauggacccuccgacggccaggccagcuacaaaauuuuucgcaucgaaaagggcaaaaucgucaagucuguugagaugaaugcuccuaacuaucauuacgaagagugcagcuguuaccccgauuccucugagauuacaugcgugugcagagacaauuggcacgggagcaaccggccuuggguguccuucaaucagaaccuggaauaucagaucggauacauuuguagcggcaucuuuggggauucuccccgcccgaaugacaaaaccggauccugcggcccugucagcucuaacggggccaauggagugaagggcuucuccuuuaaguauggcaacgggguuuggauuggaagaacaaaaagcaucuccucucggaacggcuucgagaugauuugggaucccaauggguggaccggaaccgacaacaauuuuagcaucaagcaagacaucgugggcauuaacgaaugguccggguacucuggcagcuucguccagcauccugagcuuacaggacuggauuguauccgccccugcuucuggguggaacucauuagaggccggcccaaagagaauacgaucuggaccuccgggagcucuauuuccuuuuguggaguuaacagcgacaaugugggcuggucuuggccugauggggcugagcugccguucacaaucgacaaguga

SEQ ID NO: 204426 - RNA, 1410 nt, Artificial Sequence; identical to SEQ ID NO: 199762
  derived and/or modified sequence opt5 from neuraminidase__InfluenzaA__AEW25402

SEQ ID NO: 204427 - RNA, 1410 nt, Artificial Sequence; identical to SEQ ID NO: 199762
  derived and/or modified sequence opt5 from neuraminidase__InfluenzaA__AEW25407

SEQ ID NO: 204428 - RNA, 1410 nt, Artificial Sequence
  derived and/or modified sequence opt5 from neuraminidase__InfluenzaA__AEW25418
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucauaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaucggacgcucaugucuugucccaucggggaggugccuucccccuacaacagccgcuuugaauccguugccuggucugcuagcgccugccaugacggaauuaauuggcugaccaucggcaucuccgggccugauaacggagcuguggccguccugaaguauaauggcauuaucacagacaccauuaagagcuggagaaacaauauccuccggacacaggagucugagugugcgugcgugaacggguccuguuucaccgugaugacggauggaccgagcgacggccaagccucuuacaaaauuuuucgcaucggcaaggggaaaaucgucaagagcguugaaaugaaugcucccaacuaucacuacgaggaaugcuccuguuacccugauucuagcgagauuacaugcgugugcagagacaauuggcauggauccaaccggcccugggugagcuucaaucagaaccuggaguaucagaucggcuacauuuguucugggaucuuuggagauaauccucgccccaacgacaaaaccggcuccugcgggccggucagcucuaauggagaaaacggcgugaagggcuucuccuuuaaguaugggaacggaguuuggauuggcagaacaaaaagcaucuccucucggaauggguucgagaugauuugggauccuaacggauggaccggcaccgacaauaacuuuagcaucaagcaggacaucguggggauuaaugaaugguccggcuacucuggcagcuucguccaacaccccgagcuuacaggacuggauuguauccgcccuugcuucuggguggaacucauuagagggcggcccaaagagaacacgaucuggaccuccggaagcucuauuuccuuuuguggcguuaauagcgacacaguggggugguucuggcccgauggagccgagcugccuuuuaccaucgacaaguga

SEQ ID NO: 204429 - RNA, 1410 nt, Artificial Sequence
  derived and/or modified sequence opt5 from neuraminidase__InfluenzaA__AEW25423
augaaccccaaucagaagaucauuaccaucggcagcgugugcaugacaauugggauggccaaccugauccuccaaauuggaaauaucaucuccauuuggaucucuaacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaaaggagauguguuugucauucgggagccguucaucagcuguucuccccucgaaugccgcaccuuuuuccugacacagggcgcccuucugaacgacaagcacuccaacggcaccauuaaagauagaagcccuuaucggacgcucaugucuugucccaucggggaggugccuucccccuacaauagccgcuuugaauccguugccuggucugcuagcgccugccaugacggaauuaacuggcugaccaucggcaucuccgggccugauaauggagcuguggccguccugaaguauaacggcauuaucacagacaccauuaagagcuggagaaauaacauccuccggacacaagagucugagugugcgugcgugaauggguccuguuucaccgugaugacggauggaccgagcgacggccaggccucuuacaaaauuuuucgcaucgaaaagggcaaaaucgucaagagcguugagaugaacgcucccaauuaucacuacgaagagugcuccuguuacccugauucuagcgagauuacaugcgugugcagagacaacuggcauggguccaaucggcccugggugagcuucaaccagaaucuggaauaucagaucggauacauuuguucuggcaucuuuggggauaacccucgccccaaugacaaaaccggauccugcggcccggucagcucuaacggggccaacggagugaagggcuucuccuuuaaguauggcaaugggguuuggauuggaagaacaaaaagcaucuccucucggaacggcuucgagaugauuugggauccuaauggguggaccggaaccgacaacaauuuuagcaucaagcaagacaucgugggcauuaacgaaugguccggguacucuggcagcuucguccagcaccccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 204430 - RNA, 1410 nt, Artificial Sequence; identical to SEQ ID NO: 199762
  derived and/or modified sequence opt5 from neuraminidase__InfluenzaA__AEW25426

SEQ ID NO: 204431 - RNA, 1410 nt, Artificial Sequence
  derived and/or modified sequence opt5 from neuraminidase__InfluenzaA__AEW25432
augaaccccaaucagaagaucauuaccaucggcagcgugugcaugacaauugggauggccaaccugauccuccaaauuggaaauaucaucuccauuuggacgucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggaccggaacagacaauaacagcuccauuaagcaagacaucgugggcaucaaugaauggucuggguacagcggcuccuuuguccagcaucccgagcuuacgggacuggauuguauucgcccuugcuucuggguggaacucaucagaggccggcccaaagagaacaccauuuggacaagcgggucuuccaucagcuucuguggaauuaauucugacgcuguuggcugguccuggcccgauggggccgagcugccuuuuaccaucgacaaguga

SEQ ID NO: 204432 - RNA, 1410 nt, Artificial Sequence
  derived and/or modified sequence opt5 from neuraminidase__InfluenzaA__AEW25436
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucgcauuggauacaucuguucuggcauuuuuggggauaauccuagacccaacgacaaaaccggauccugcggcccggugagcucuaauggggccaacggagucaagggcuucuccuuuaaguauggcaacgggguguggaucggacggacaaaaagcauuuccucucgcaauggcuucgagaugaucugggauccuaacggguggaccggaaccgacaauaacuuuagcaucaagcaggacauuguuggcacaaaugaaugguccggguacucuggcagcuucgugcaacaucccgagcuuacgggacuggauuguaucagaccuugcuucugggucgaacucauucggggccgccccaaagagaacaccaucuggacauccgggagcucuauuuccuuuuguggagugaauagcgacaccaugggcuggucuuggcccgauggggcugagcugccuuucacaaucgacaaguga

SEQ ID NO: 204433 - RNA, 1410 nt, Artificial Sequence; identical to SEQ ID NO: 199762
  derived and/or modified sequence opt5 from neuraminidase__InfluenzaA__AEW25440

SEQ ID NO: 204434 - RNA, 1410 nt, Artificial Sequence
  derived and/or modified sequence opt5 from neuraminidase__InfluenzaA__AEW25448
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccacagacaaguga

SEQ ID NO: 204435 - RNA, 1410 nt, Artificial Sequence; identical to SEQ ID NO: 199762
  derived and/or modified sequence opt5 from neuraminidase__InfluenzaA__AEW25456

SEQ ID NO: 204436 - RNA, 1410 nt, Artificial Sequence
  derived and/or modified sequence opt5 from neuraminidase__InfluenzaA__AEW25464
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagcugaaugcucccaacuaucauuacgaagagugcuccuguuacccugauucuagcgagauuacaugcgugugcagagacaauuggcacggguccaaccggcccugggugagcuucaaucagaaccuugaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcugacaggacucgauuguauccgcccuugcuucuggguggaacugauuagaggccggcccaaagagaacacgaucuggaccuccgggagcucuauuuccuuuuguggaguuaauagcgacacagugggcuggucuuggcccgauggggcugagcuuccuuucaccaucgacaaguga

SEQ ID NO: 204437 - RNA, 1410 nt, Artificial Sequence
  derived and/or modified sequence opt5 from neuraminidase__InfluenzaA__AEW25474
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuccaccaucgacaaguga

SEQ ID NO: 204438 - RNA, 1410 nt, Artificial Sequence
  derived and/or modified sequence opt5 from neuraminidase__InfluenzaA__AEW25484
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggaucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucucaucucgaaugccgcaccuuuuuccugacacagggcgcccuucugaaugacaagcacuccaacggcaccaucaaagauagaagccccuaucggacgcucaugucuuguccuauuggggagguccccuccccuuacaacagccgcuuugaauccguggccuggucugcuagcgccugccaugacggaaucaauuggcugaccaucggcauuuccgggcccgaucacggagcuguugccgugcugaaguauaacggcaucauuacagacaccaucaagagcuggagaaauaacauucuccggacacaagagucugagugugcgugcgucaauggguccuguuucaccgugaugacggauggaccuagcgacggccaggccucuuacaaaaucuuucgcaucgaaaagggcaaaauugucaagagcguggagaugaacgcuccgaauuaucauuacgaagagugcuccuguuaccccgauucuagcgagaucacaugcguuugcagagacaacuggcacggguccaaucggccuugggugagcuucaaccagaaucuggaauaucagauuggauacaucuguucuggcauuuuuggggauaacccccgcccuaaugacaaaaccggauccugcggccccgugagcucuaacggggccaauggagucaagggcuucuccuuuaaguauggcaacgggguguggaucggaagaacaaaaagcauuuccucucggaacggcuucgagaugaucugggauccgaauggguggaccggaaccgacaacaauuuuagcaucaagcaagacauuguuggcaucaacgaaugguccggguacucuggcagcuucgugcagcacccugagcuuacaggacuggauuguauucgccccugcuucugggucgaacucaucagaggccggccuaaagagaauacgauuuggaccuccgggagcucuaucuccuuuuguggagugaacagcgacacaguuggcuggucuuggcccgauggggcugagcugcccuucaccaucgacaaguga

SEQ ID NO: 204439 - RNA, 1410 nt, Artificial Sequence
  derived and/or modified sequence opt5 from neuraminidase__InfluenzaA__AEW25494
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacagcauuaagucuuggagaaacaauauccuccggacccaagaguccgagugugcgugcgugaacgggagcuguuucacagugaugaccgauggaccgucugacggccaggccagcuacaaaauuuuucgcaucgaaaagggcaaaaucgucaaguccguugagaugaaugcucccaacuaucauuacgaagagugcucuuguuacccugauagcuccgagauuacgugcgugugcagagacaauuggcacgggagcaaccggcccugggugucuuucaaucagaaccuggaauaucagaucggauacauuuguuccggcacauuuggggauaauccucgccccaacgacaaaaccggaagcugcggcccggucucuuccaauggggccaacggagugaagggcuucagcuuuaaguauggcaacgggguuuggaucggaagaacaaaauccauuucuagccggaauggcuucgagaugaucugggauccuaacggguggaccggaaccgacaauaacuuuuccauuaagcaagacaucgugggcaucaaugaauggucuggguacagcggcuccuucguccagcaucccgagcuuacaggacuggauuguauucgcccuugcuucuggguggaacucaucagaggccggcccaaagagaacacgauuuggaccagcgggucuuccaucagcuuuuguggaguuaauucugacacagugggcugguccuggcccgauggggcugagcugccuuucaccauugacaaguga

SEQ ID NO: 204440 - RNA, 1410 nt, Artificial Sequence
  derived and/or modified sequence opt5 from neuraminidase__InfluenzaA__AEW25503
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacggggcuuggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggccgagcugccuuucaccaucgacaaguga

SEQ ID NO: 204441 - RNA, 1410 nt, Artificial Sequence
  derived and/or modified sequence opt5 from neuraminidase__InfluenzaA__AEW25511
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucauaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggaguggucuuugugauucgggagccguucaucagcuguucuccccucgaaugccgcaccuuuuuccugacacagggcgcccuucugaaugauaagcacuccaacggcaccauuaaagacagaagcccuuaucggacgcucaugucuugucccaucggggagguuccuucccccuacaacagccgcuuugaauccguggccuggucugcuagcgccugccaugauggaauuaauuggcugaccaucggcaucuccgggccugacaacggagcugucgccgugcugaaguauaauggcauuaucacagauaccauuaagagcuggagaaacaauauccuccggacacaggagucugagugugcgugcgugaacggguccuguuucaccgucaugacggacggaccgagcgauggccaagccucuuacaaaauuuuucgcaucgaaaagggcaaaaucguuaagagcguggagaugaaugcucccaacuaucacuacgaagagugcuccuguuacccugacucuagcgagauuacaugcgugugcagagauaauuggcauggguccaaccggcccugggucagcuucaaucagaaccuggaauaucagaucggauacauuuguucuggcaucuuuggggacaauccucgccccaacgauaaaaccggauccugcggcccggugagcucuaauggggccaacggaguuaagggcuucuccuuuaaguauggcaacgggguguggauuggaagaacaaaaagcaucuccucucggaauggcuucgagaugauuugggacccuaacggguggaccggaaccgauaauaacuuuagcaucaagcaggacaucgucggcauuaaugaaugguccggguacucuggcagcuucgugcaacaccccgagcuuacaggacuggacuguauccgcccuugcuucuggguugaacucauuagaggccggcccaaagagaacacgaucuggaccuccgggagcucuauuuccuuuuguggagugaauagcgauacagucggcuggucuuggcccgacggggcugagcugccuuucaccaucgauaaguga

SEQ ID NO: 204442 - RNA, 1410 nt, Artificial Sequence
  derived and/or modified sequence opt5 from neuraminidase__InfluenzaA__AEW25530
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucauaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaucggacgcucaugucuugucccaucggggaggugccuucccccuacaacagccgcuuugaauccguugccuggucugcuagcgccugccaugacggaauuaauuggcugaccaucggcaucuccgggccugauaacggagcuguggccguccugaaguauaauggcauuaucacagacaccauuaagagcuggagauacaacauccuccggacacaggagucugagugugcgugcgugaauggguccuguuucaccgugaugacggauggaccgagcgacggccaagccucuuauaaaauuuuucgcaucgaaaagggcaaaaucgucaagagcguugagaugaacgcucccaauuaccacuacgaagagugcuccuguuauccugauucuagcgagauuacaugcgugugcagagacaacuggcauggguccaaucggcccugggugagcuucaaccagaaucuggaauaccagaucggauauauuuguucuggcaucuuuggggauaacccucgccccaaugacaaaaccggauccugcggcccggucagcucuaacggggagaauggagugaagggcuucuccuuuaaguacggcaacgggguuuggauuggaagaacaaaaagcaucuccucucggaacggcuucgaaaugauuugggauccuaauggguggaccggaaccgacaacaauuuuagcaucaagcaggacaucgugggcauuaacgagugguccggguauucuggcagcuucguccaacaccccgaacuuacaggacuggauuguauccgcccuugcuucuggguggagcucauuagaggccggcccaaagagaauacgaucuggaccuccgggagcucuauuuccuuuuguggaguuaacagcgacacagugggcuggucuuggcccgauggggccgaacugccuuucaccaucgacaaguga

SEQ ID NO: 204443 - RNA, 1410 nt, Artificial Sequence
  derived and/or modified sequence opt5 from neuraminidase__InfluenzaA__AEW25537
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaaccaucacuaugaagagugcuccuguuacccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 204444 - RNA, 1410 nt, Artificial Sequence; identical to SEQ ID NO: 199762
  derived and/or modified sequence opt5 from neuraminidase__InfluenzaA__AEW25547

SEQ ID NO: 204445 - RNA, 1410 nt, Artificial Sequence; identical to SEQ ID NO: 199762
  derived and/or modified sequence opt5 from neuraminidase__InfluenzaA__AEW25556

SEQ ID NO: 204446 - RNA, 1410 nt, Artificial Sequence; identical to SEQ ID NO: 199762
  derived and/or modified sequence opt5 from neuraminidase__InfluenzaA__AEW25566

SEQ ID NO: 204447 - RNA, 1410 nt, Artificial Sequence
  derived and/or modified sequence opt5 from neuraminidase__InfluenzaA__AEW25584
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaaggcaucguggggauuaaugaaugguccggcuacggaggcucuuucguccagcaucccgagcuuacagggcuggacuguauccgcccuugcuucuggguggaacucauuagaggacggcccaaagagaacacgaucuggaccagcggcuccagcauuucuuuuugugggguuaauuccgauacagugggauggagcuggcccgacggcgcugagcugccuuucaccaucgauaaguga

SEQ ID NO: 204448 - RNA, 1410 nt, Artificial Sequence; identical to SEQ ID NO: 199762
  derived and/or modified sequence opt5 from neuraminidase__InfluenzaA__AEW25592

SEQ ID NO: 204449 - RNA, 1410 nt, Artificial Sequence
  derived and/or modified sequence opt5 from neuraminidase__InfluenzaA__AEW25602
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaagaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 204450 - RNA, 1410 nt, Artificial Sequence
  derived and/or modified sequence opt5 from neuraminidase__InfluenzaA__AEW25612
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgaccgccaggccucuuacaaaauuuuuagaaucgaaaagggcaaaaucgucaagagcguugagaugaaugcucccaacuaucauuacgaagagugcuccuguuacccugauucuagcgagauuacaugcgugugccgggacaauuggcacggcuccaaccgccccugggugagcuucaaucagaaccuggaauaucagaucggguacauuuguucuggaaucuuuggcgauaauccuagacccaacgacaaaaccggguccugcggaccggucagcucuaauggcgccaacggggugaagggauucuccuuuaaguauggcaacggcguuuggauugggcggacaaaaagcaucuccucucgcaauggauucgagaugauuugggauccuaacggcuggaccgggaccgacaauaacuuuagcaucaagcaagacaucgugggaauuaaugaaugguccggcuacucugggagcuucguccagcaucccgagcuuacaggccuggauuguaucagaccuugcuucuggguggaacucauucggggacgccccaaagagaacacgaucuggaccuccggcagcucuauuuccuuuugugggguuaauagcgacacagugggauggucuuggcccgauggcgcugagcugccuuucaccaucgacaaguga

SEQ ID NO: 204451 - RNA, 1410 nt, Artificial Sequence
  derived and/or modified sequence opt5 from neuraminidase__InfluenzaA__AEW25622
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacuccaucuggacgagcgggucuuccauuagcuuuuguggaguuaauucugacaccgugggcugguccuggcccgauggggcugagcugccuuucacaaucgacaaguga

SEQ ID NO: 204452 - RNA, 1410 nt, Artificial Sequence
  derived and/or modified sequence opt5 from neuraminidase__InfluenzaA__AEW25631
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccuccggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 204453 - RNA, 1410 nt, Artificial Sequence; identical to SEQ ID NO: 199762
  derived and/or modified sequence opt5 from neuraminidase__InfluenzaA__AEW25639

SEQ ID NO: 204454 - RNA, 1410 nt, Artificial Sequence
  derived and/or modified sequence opt5 from neuraminidase__InfluenzaA__AEW25648
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucauaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaucggacgcucaugucuugucccaucggggaggugccuucccccuacaacagccgcuuugaauccguugccuggucugcuagcgccugccaugacggaauuaauuggcugaccaucggcaucuccgggccugauaacggagcuguggccguccugaaguauaauggcauuaucacagacaccauuaagagcuggagaaacaauauccuccggacacaggagucugagugugcgugcgugaacggguccuguuucaccgugaugacggauggaccgagcgacggccaagccucuuacaaaauuuuucgcaucgaaaagggcaaaaucgucaagagcguugagaugaaugcucccaacuaucacuacgaagagugcuccuguuacccugauucuagcgagauuacaugcgugugcagagacaauuggcauggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaggacaucgugggcauuaaugaaugguccggguacucuggcagcuucguccaacaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 204455 - RNA, 1410 nt, Artificial Sequence
  derived and/or modified sequence opt5 from neuraminidase__InfluenzaA__AEW25656
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuucccaucaagcaagacaucgugggcauuaaugaauggagcggguacuccggcucuuucguccagcauccugagcuuacaggacuggauuguauccgccccugcuucuggguggaacucauuagaggccggcccaaagagaacacgaucuggaccagcggguccagcauuucuuuuuguggaguuaauuccgacacagugggcuggagcuggccugauggggcugagcugccguucaccaucgacaaguga

SEQ ID NO: 204456 - RNA, 1410 nt, Artificial Sequence
  derived and/or modified sequence opt5 from neuraminidase__InfluenzaA__AEW25664
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucaccgcugggcagagcguggucuccgugaaacuugccggaaauucuagccugugcccuguuuccggcugggcgauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacgauuaaagauagaagcccuuaucggacccucaugucuugucccaucggggaggugccuucccccuacaacagccgcuuugaauccguugcuuggucugccagcgcuugccacgacggaauuaauuggcugacaaucggcaucuccgggccugauaacggagccguggcuguccugaaguauaauggcauuaucaccgacacaauuaagagcuggagaaacaauauccuccggacccaagagucugagugugccugcgugaacggguccuguuucacggugaugacagauggaccgagcgacggccaggcgucuuacaaaauuuuucgcaucgaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggaccggaacagacaauaacuuuagcaucaagcaagacaucgugggcauuaaugaaugguccggguacucuggcagcuucguccagcaucccgagcuuacgggacuggauuguauccgcccuugcuucuggguggaacucauuagaggccggcccaaagagaacaccaucuggacauccgggagcucuauuuccuuuuguggaguuaauagcgacaccggcggguggucuuggcccgauggagccgagcugccuuucacaaucgacaaguga

SEQ ID NO: 204457 - RNA, 1410 nt, Artificial Sequence; identical to SEQ ID NO: 204451
  derived and/or modified sequence opt5 from neuraminidase__InfluenzaA__AEW25671

SEQ ID NO: 204458 - RNA, 1410 nt, Artificial Sequence; identical to SEQ ID NO: 200939
  derived and/or modified sequence opt5 from neuraminidase__InfluenzaA__AEW25680

SEQ ID NO: 204459 - RNA, 1410 nt, Artificial Sequence
  derived and/or modified sequence opt5 from neuraminidase__InfluenzaA__AEW25689
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagagugggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 204460 - RNA, 1410 nt, Artificial Sequence; identical to SEQ ID NO: 204454
  derived and/or modified sequence opt5 from neuraminidase__InfluenzaA__AEW25698

SEQ ID NO: 204461 - RNA, 1410 nt, Artificial Sequence; identical to SEQ ID NO: 199762
  derived and/or modified sequence opt5 from neuraminidase__InfluenzaA__AEW25708

SEQ ID NO: 204462 - RNA, 1410 nt, Artificial Sequence; identical to SEQ ID NO: 199762
  derived and/or modified sequence opt5 from neuraminidase__InfluenzaA__AEX09177

SEQ ID NO: 204463 - RNA, 1413 nt, Artificial Sequence
  derived and/or modified sequence opt5 from neuraminidase__InfluenzaA__AEX33324
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucacaaucaauaacaccaauguuguggccggaaaagacaagacaucugugacccuggcgggcaacagcucccuuuguagcauuucugggugggcuaucuacacgaaagauaauuccauucggaucggaagcaagggcgacgucuucgugauucgcgagccuuuuaucucuugcucccaucuggaguguagaaccuucuuucucacacaaggcgcccugcuuaacgauaaacacagcaaugggaccguuaaggaccggucuccguaucgcgcccugauguccugcccccucggagaagcuccuagccccuacaacuccaaguucgagucuguggccuggagcgcuuccgccugucaugauggcaugggguggcugacaaucggaauuagcggcccugacaauggggcggucgccgugcugaaauauaacggaaucauuaccgaaacgaucaagucuuggaaaaagcggauucucagaacacaggaguccgagugcguuugugugaacggcagcugcuuuaccaucaugacagauggccccucuaauggggcugccagcuacaaaaucuucaagauugaaaagggaaaagucaccaaguccaucgagcugaacgcuccuaauuuucacuaugaagaguguucuugcuacccggacaccggcacagugaugugugugugccgcgauaacuggcacgggagcaauagacccugggucuccuucaaccagaaucuugacuaccagauuggauauaucugcagcggcguuuuuggggauaacccucggcccaaagacggagagggcucuuguaauccugugacgguggauggcgccgacggggucaagggauucuccuacaaauauggcaacgggguguggauuggacgcaccaagagcaauagacugcggaaaggcuuugaaaugaucugggaccccaacggguggacagauaccgacucugauuucuccguuaagcaagacguggucgcgauuacagauuggagcggcuacuccggaucuuuugugcagcauccggagcucaccggccuggacugcauccgcccuuguuucuggguugaacuugugagagggcugccccgggagaauacgacaaucuggaccagcggauccucuauuagcuucugcggcgucaacuccgauaccgccaauuggagcuggccugacggggcugaacuccccuuuacaaucgauaaguga

SEQ ID NO: 204464 - RNA, 1413 nt, Artificial Sequence
  derived and/or modified sequence opt5 from neuraminidase__InfluenzaA__AEX33368
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuugugcuauuagcgggugggccaucuacaccaaagauaacucuauucggaucggauccaagggcgacgucuucgugauucgcgagccuuuuaucagcugcucucaucuggaguguagaacguucuuucucacccaaggcgcccugcuuaaugauaaacacuccaacgggacaguuaaggaccggagcccguaucgcgcucugaugucuugcccccucggagaagccccuucccccuacaauagcaaguucgaguccguggcuuggucugccagcgcgugucaugauggcaugggguggcugaccaucggaauuuccggcccugacaacggggccgucgcugugcugaaauauaacggaaucauuacagaaaccaucaagagcuggaaaaagcggauucucagaacgcaggagucugagugcguuugugugaauggcuccugcuuuacaaucaugaccgauggccccagcaacggggccgcuucuuacaaaaucuucaagauugaaaagggaaaagucacaaagagcaucgagcugaaugccccuaacuuucacuaugaagaguguuccugcuacccggacaccggcaccgugaugugugugugccgcgauaauuggcacgggucuaacagacccugggucagcuucaaucagaaccuugacuaccagauuggauauaucugcuccggcguuuuuggggauaauccucggcccaaagacggagagggcagcuguaacccugugacaguggauggcgcggacggggucaagggauucucuuacaaauauggcaaugggguguggauuggacgcacgaaguccaacagacugcggaaaggcuuugaaaugaucugggaccccaauggguggaccgauacagacagcgauuucucuguuaagcaagacguggucgccauuaccgauugguccggcuacagcggauccuuugugcagcauccggagcucacaggccuggacugcauccgcccuuguuucuggguugaacuugugagagggcugccccgggagaacaccacgaucuggacaucuggaagcuccauuucuuucugcggcgucaauagcgauaccgcuaacugguccuggccugacggggccgaacuccccuuuaccaucgauaaguga

SEQ ID NO: 204465 - RNA, 1413 nt, Artificial Sequence
  derived and/or modified sequence opt5 from neuraminidase__InfluenzaA__AEX33379
augaaccccaaucagaagaucauuaccaucggcagcauuuccaucgccauugggaucaucucucugaugcuccaaauuggaaacaucauuagcaucugggcuucccacucuauucagacaggcauccagaaucauacggggauuugcaaccagagaaucaucaccuacgagaauagcacaugggugaaccacaccuaugucacaauuaauaacaccaauguuguggccggaaaagacaagacauccgugacccuggcgggcaacucuagccuuuguuccaucagcgggugggcuauuuacacgaaagauaauucuauccggauuggauccaagggcgacgucuucgugauccgcgaaccuuuuaucagcugcucucaucuggaguguagaaccuucuuucucacacaaggcgcccugcuuaacgauaaacacuccaaugggaccguuaaggaccggagcccguaucgcgcccugaugucuugcccccucggagaagcuccuucccccuacaacagcaaguucgaguccguggccuggucugcuagcgccugucaugauggcaugggguggcugacaauuggaaucuccggcccugacaauggggcggucgccgugcugaaauauaacggaauuaucaccgaaacgauuaagagcuggaaaaagagaauccuccggacacaggagucugagugcguuugugugaacggcuccugcuuuaccaucaugacagauggccccagcaauggggcugccucuuacaaaauuuucaagaucgaaaagggaaaagucaccaagagcauugagcugaacgcuccuaauuuucacuaugaagaguguuccugcuacccggacaccggcacagugaugugugugugccgcgauaacuggcacgggucuaauagacccugggucagcuucaaccagaaucuugacuaccagaucggauauauuugcuccggcguuuuuggggauaacccucggccccgcgacggagagggcagcuguaauccugugacgguggauggcgccgacggggucaaaggauucucuuacaaguauggcaacgggguguggaucggaagaaccaaauccaaucggcugcgcaagggcuuugaaaugauuugggaccccaacggguggacagauaccgacagcgauuucucuguuaaacaagacguggucgcgaucacagauugguccggcuacagcggauccuuugugcagcauccggagcucaccggccuggacugcaucagaccuuguuucuggguugaacuugugcgggggcugccccgcgagaauacgacaauuuggaccucuggaagcuccaucucuuucugcggcgucaacagcgauaccgccaauugguccuggccugacggggcugaacuccccuuuacaauugauaaguga

SEQ ID NO: 204466 - RNA, 1413 nt, Artificial Sequence; identical to SEQ ID NO: 204465
  derived and/or modified sequence opt5 from neuraminidase__InfluenzaA__AEX33390

SEQ ID NO: 204467 - RNA, 1413 nt, Artificial Sequence; identical to SEQ ID NO: 204465
  derived and/or modified sequence opt5 from neuraminidase__InfluenzaA__AEX33401

SEQ ID NO: 204468 - RNA, 1413 nt, Artificial Sequence; identical to SEQ ID NO: 204465
  derived and/or modified sequence opt5 from neuraminidase__InfluenzaA__AEX33412

SEQ ID NO: 204469 - RNA, 1413 nt, Artificial Sequence; identical to SEQ ID NO: 204465
  derived and/or modified sequence opt5 from neuraminidase__InfluenzaA__AEX33423

SEQ ID NO: 204470 - RNA, 1413 nt, Artificial Sequence; identical to SEQ ID NO: 204465
  derived and/or modified sequence opt5 from neuraminidase__InfluenzaA__AEX33434

SEQ ID NO: 204471 - RNA, 1413 nt, Artificial Sequence; identical to SEQ ID NO: 204465
  derived and/or modified sequence opt5 from neuraminidase__InfluenzaA__AEX33445

SEQ ID NO: 204472 - RNA, 1410 nt, Artificial Sequence
  derived and/or modified sequence opt5 from neuraminidase__InfluenzaA__AEX33544
augaaccccaaucagaagaucauuaccaucggcagcuucucccugacaauugccgcuaucugcuuucucaugcaaauugccauccuggugacgaccgucacacuucacuucaaacagcaugaguguaacucuccuccgaauaaccagguuaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguuugcuccuuucuccaaagacaauucuauucgccuuagcgccggaggcgauaucugggugaccagagagcccuacgucuccugugacccugauaagugcuaucaauuugcccuggggcagggaacaacccucaacaauggccacucuaacgacacagugcaugaucggaccccguaccgcacgcugcugaugaaugaacucgggguucccuuccaccugggaacaagacagguguguaucgcuuggagcuccagcucuugccaugacggcaaggccuggcuucacgucugugugaccggcgaugacaaaaacgcuacagccuccuuuauuuauaaugggcggcugguugauagcaucggaucuugguccaagaaaauucuccgcacccaggagagcgaaugcguguguaucaacgggaccugcacagucgugaugacggacggcucugcguccggaaaggccgauaccaaaauucuguucaucgaggagggcaagaucgugcacauuagcacacuuuccgggucugcucaacaugucgaagagugcagcuguuacccuagauaucccggaguucggugcgugugucgcgacaacuggaagggcuccaauagaccuaucguggauauuaacgucaaagacuacagcaucgugucuuccuacguuugcagcggccuggugggggacacaccccggaagaaugauucuuuuagcuccucucacugucucgacccgaacaaugaagagggaggccauggggucaaaggaugggccuucgaugacggcaacgauguguggauggggcgcaccauuagcgaaaagcugagauccggauaugagaccuuuaaaguuaucgagggcuggagcaagccuaauucuaaacugcagaucaaccgccaggugauugucgaacggggcaauagauccggguacagcggaaucuucucuguggagggcaaguccugcauuaaccgguguuuuuaugucgaacucaucagagggcgcaaggagaaaacggaagugugguggacaagcaauuccauuguuguguucugcggaaccucuggcaccuacgggacaggcagcuggcccgacggagcugauaucaaccugaugccuauuuga

SEQ ID NO: 204473 - RNA, 1410 nt, Artificial Sequence; identical to SEQ ID NO: 197738
  derived and/or modified sequence opt5 from neuraminidase__InfluenzaA__AEX33555

SEQ ID NO: 204474 - RNA, 1410 nt, Artificial Sequence
  derived and/or modified sequence opt5 from neuraminidase__InfluenzaA__AEX33610
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucagugugacauuaccggguucgcccccuuuuccaaagauaacucuauccgccugagcgcgggaggcgacaucugggugacaagagagccuuaugucuccugcgauccggacaaguguuaccaauucgcucuugggcagggaaccacacugaauaacgugcauucuaaugauaccguucacgaccggacgcccuaucgcacacuccugaugaacgaacugggcgugccuuuucaucucgggaccaagcaggucugcauugccuggagcuccagcucuugucacgauggaaaagccuggcugcaugugugcguuacaggcgacgauaagaaugcuaccgccuccuucaucuacaacggcagacuuguggacagcauugucucuugguccaaaaagauccugcggacccaggagagcgaaugugugugcauuaaugggacauguacgguggucaugaccgauggaucugcuuccggcaaagccgacacaaagauccucuuuaucgaggaggggaagauuguucacaccagcacacuguccggaucugcgcaacacguggaagagugcagcugcuauccccgcuacccuggcgugagaugugucugccgggauaacuggaaaggguccaaccgccccaucguggacauuaauaucaaggacuacaacauuguuagcucuuauguguguuccggacuugucggcgauaccccgcggaaaaaugacagcucuagcuccucucauugccuggauccuaacaaugaagagggcgggcacggagugaagggcugggccuucgacgaugggaacgacguuuggaugggaagaacgaucagcgaaaaacuccgcuccggcuacgagacauuuaaggugaucgggggauggagcaaucccaacucuaaacugcagauuaauagacaggucaucguggaucggggcaaccgcuccggcuauagcgggauuuucucugucgagggaaaguccuguaucaauagaugcuuuuacguggaacugauucggggcagaaaggaggaaaccgagguucucuggaccagcaacuccaucguggucuucugugggacaucuggaaccuauggcacagggagcuggccugacggcgcugauauuaaucugaugcccaucuga

SEQ ID NO: 204475 - RNA, 1410 nt, Artificial Sequence
  derived and/or modified sequence opt5 from neuraminidase__InfluenzaA__AEX33828
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucagugugacauuaccggguucgcccccuuuuccaaagauaacucuauccgccugagcgcgggaggcgacaucugggugacaagagagccuuaugucuccugcgauccggacaaguguuaccaauucgcucuugggcagggaaccacacugaauaacgugcauucuaaugauaccguucacgaccggacgcccuaucgcacacuccugaugaacgaacugggcgugccuuuucaucucgggaccaagcaggucugcauugccuggagcuccagcucuugucacgauggaaaagccuggcugcaugugugcguuacaggcgacgauaagaaugcuaccgccuccuucaucuacaacggcagacuuguggacagcauugucucuugguccaaagagauccugcggacccaggaaagcgagugugugugcauuaaugggacauguacgguggucaugaccgauggaucugcuuccggcaaggccgacacaaaaauccucuuuaucgaggaagggaagauuguucacaccagcacacuguccggaucugcgcaacacguggaggaaugcagcugcuauccccgcuacccuggcgugagaugugucugccgggauaacuggaagggguccaaccgccccaucguggacauuaauaucaaagacuacagcauuguuucuuccuauguguguagcggacuugucggcgauaccccgagaaagaacgacucuagcuccucuagccauugccuggauccuaauaacgaggaaggcgggcacggagugaaaggcugggccuucgacgaugggaaugacguuuggaugggacggacgaucuccgagaagcuccgcagcggcuacgagacauuuaaagugaucgaaggguggucuaaccccaauuccaagcugcagauuaacagacaggucaucguggaucggggaaaucgcagcggcuauucuggcauuuucuccgucgaggggaaaagcuguaucaacagaugcuuuuacguggaacugauucggggaagaaaggaggaaaccgagguucucuggaccuccaauucuaucguggucuucuguggcacaagcgggaccuauggaacaggcuccuggccugacggggcugauauuaaccugaugcccaucuga

SEQ ID NO: 204476 - RNA, 1410 nt, Artificial Sequence; identical to SEQ ID NO: 197736
  derived and/or modified sequence opt5 from neuraminidase__InfluenzaA__AEX33839

SEQ ID NO: 204477 - RNA, 1413 nt, Artificial Sequence
  derived and/or modified sequence opt5 from neuraminidase__InfluenzaA__AEX33861
augaaccccaaucagaagaucauuaccaucggcagcauuuccaucgccauugggacaaucucucugaugcuccaagugggaaacaucauuagcaucugggcuucccacucuauucagacgggcagccagaaucauaccgggaucugcaaccagagaauuaucacauacgagaauagcaccugggucaaccacacauauguuaauauuaacaauaccaacgugguggccggaaaagacaagacaucugucgcgcuggcuggcaauagcucccuuuguagcaucucugggugggccaucuacaccaaagauaacuccauucggaucggaagcaagggcgacguguucguuauucgcgaaccuuuuaucucuugcucccaucuggaguguagaacguucuuucucacccaaggcgcccugcuuaaugauaaacacagcaacgggacagugaaggaccggucuccguaucgcgcucugauguccugcccccucggagaagccccuagccccuacaauuccaaguucgagucugucgcuuggagcgccuccgcgugucaugauggcaugggguggcugaccauuggaaucagcggcccugacaacggggccguggcuguucugaaauauaacggaaucauuacagaaaccaucaagucuuggaaaaagcggauucucagaacgcaggaguccgagugcgugugugucaauggcagcugcuuuacaaucaugaccgauggccccucuaacggggccgcuagcuacaaaauuuucaagaucgaaaagggacaggugacaaaauccguggagcugaaugccccuaacuuucacuaugaagaguguucuugcuacccggacaccggcaccgucauguguguuugccgcgauaauuggcacgggagcaacagacccuggguguccuucaaucagaaccuugacuaccaaaucggauauauuugcagcggcguguuuggggauaauccucggcccaaggacggaaaaggcucuuguaacccugucacaguggauggcgcggacgggguuaagggauucuccuacaaauauggcaaugggguguggaucggacgcacgaaguccaacagacugcggaaaggcuuugagaugauuugggaccccaauggguggaccgauacagacucugauuucuccgucaagcaggacgugguugccaucaccgauuggagcggcuacuccggaucuuuugugcagcauccggaacucacaggccuggacugcauucgcccuuguuucugggucgagcuugugagagggcugccccgggaaaacaccacgaucuggacaagcggauccucuauuagcuucugcggcgucgauuccgacaccgcuaauuggagcuggccugauggggccgagcuccccuuuaccaucgacaaguga

SEQ ID NO: 204478 - RNA, 1410 nt, Artificial Sequence
  derived and/or modified sequence opt5 from neuraminidase__InfluenzaA__AEX33872
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcagugugaacccacaauuaucgagagaaauauuaccgaaaucguguaucuuacaaacaccacgauugagaaggaaaucugcccuaaacuggcugaguaccggaauugguccaagccccaaugugacauuaccggguucgccccuuuuucuaaagauaacagcauccgccucuccgcgggaggcgacaucugggugacaagagagcccuaugucucuugcgauccugacaaguguuaccaguucgcucuggggcagggaaccacacuuaauaacgugcauagcaaugauaccguucacgaccggacgccguaucgcacacugcucaugaacgaacugggcgugcccuuucaucuggggaccaagcaggucugcauugccugguccucuagcuccugucacgauggaaaagccuggcuccaugugugcguuacaggcgacgauaagaaugcuaccgccagcuucaucuacaacggcagacugguggacucuauugucuccuggagcaaagagauccuucggacccaagaaucugagugugugugcauuaaugggacauguacgguggucaugaccgauggauccgcuagcggcaaggccgacacaaaaauccuguuuaucgaggaagggaagauuguucacaccuccacacucucuggaagcgcgcagcacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuggucggcgauacccccagaaagaacgacagcuccucuagcucccauugccuuaauccgaacaaugaggaaggcgggcacggagugaaaggcugggccuucgaugacgggaacgauguuuggaugggacggacgaucagcgagaagcugcgccucggcuacgagacauuuaaagugaucgaaggguggucuaauccuaacuccaagcugcagauuaauagacaggucaucguggaccggggaaaccgcagcggcuauucuggcauuuucuccgucgaggggaaaagcuguaucaauagaugcuuuuacguggaacugauucggggaagaaaggaggaaaccgagguucucuggaccuccaacucuaucguggucuucuguggcacaagcgggaccuauggaacaggcuccuggcccgauggggcugacauuaaucugaugccuaucuga

SEQ ID NO: 204479 - RNA, 1410 nt, Artificial Sequence; identical to SEQ ID NO: 197736
  derived and/or modified sequence opt5 from neuraminidase__InfluenzaA__AEX33883

SEQ ID NO: 204480 - RNA, 1410 nt, Artificial Sequence
  derived and/or modified sequence opt5 from neuraminidase__InfluenzaA__AEX33894
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauugacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauauuaaccugaugccuaucuga

SEQ ID NO: 204481 - RNA, 1413 nt, Artificial Sequence
  derived and/or modified sequence opt5 from neuraminidase__InfluenzaA__AEX33916
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguuguggccgagaaagacaagaccucugugacacuggcgggaaacagcucccuuuguagcaucucuggcugggcuauuuacaccaaagauaauuccauccggauugggagcaagggagacgucuucgugauccgcgagccuuuuaucucuugcucccaccuggaauguagaacguucuuucucacccaaggcgcccugcuuaacgauaaacauagcaauggcacaguuaaggaccggucuccguaucgcgcccugauguccugcccccucggggaggcuccuagccccuacaacuccagauucgaaucuguggccuggagcgcuuccgccugucacgauggaaugggcuggcugaccauugggaucagcggaccugacaacggcgcggucgccgugcugaaguauaaugggauuaucacagagaccauuaaaucuuggaagaaacggauccuccgcacgcaggaguccgaaugcguuuguaugaacggaagcugcuuuacaaucaugaccgauggccccucuaauggcgcugccagcuacaagauuuucaaaaucgagaaggggaaggugacaaaaaccauugaacugaacgcuccuaauuuucauuaugaggaguguuccugcuacccggacaccggaacagucaugugugugugcagagauaacuggcacggcucuaaucggcccugggugagcuucaaccagaaucuugacuaccagacgggguauaucugcuccggagucuuuggcgauaacccucgccccaaggacggggaaggaagcuguaauccuaugaccguugauggcgccgacggcgugaaaggguucucuuacaaguauggaaacggcguguggauugggagaacaaaauccaaucggcugcgcaagggauuugagaugaucugggaccccaacggcuggaccaauacagauagcgacuucucugucaaacaagaugugguugcgauuaccgacugguccggguacagcggcuccuuugugcagcacccggaacucacgggacuggauugcaucagaccuuguuucugggucgagcuugugcggggccugccccgcgaaaacacaaccaucuggaccucugggagcuccauuucuuucugcggaguuaacagcggcacagccaauugguccuggccugacggggcugagcuccccuuuaccaucgauaaguga

SEQ ID NO: 204482 - RNA, 1413 nt, Artificial Sequence; identical to SEQ ID NO: 198893
  derived and/or modified sequence opt5 from neuraminidase__InfluenzaA__AEX33927

SEQ ID NO: 204483 - RNA, 1413 nt, Artificial Sequence
  derived and/or modified sequence opt5 from neuraminidase__InfluenzaA__AEX33938
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguugugguggagaaagacaagaccucugucacacuggccggaaacagcucccuuuguagcaucucuggcugggcgauuuacaccaaagauaauuccauccggauugggagcaagggagacguguucguuauccgcgagccuuuuaucucuugcucccaccuggaauguagaacguucuuucucacccaaggcgcucugcuuaacgauaaacauagcaauggcacagugaaggaccggucuccguaucgcgcccugauguccugcccccucggggaggccccuagccccuacaacuccagauucgaaucugucgcuuggagcgccuccgcuugucacgauggaaugggcuggcugaccauugggaucagcggaccugacaacggcgccguggcgguucugaaguauaaugggauuaucacagagaccauuaaaucuuggaagaaacggauccuccgcacgcaggaguccgaaugcguguguaugaacggaagcugcuuuacaaucaugaccgauggccccucuaauggcgccgcuagcuacaagauuuucaaaaucgagaaggggaaggucacaaaaaccauugaacugaacgccccuaauuuucauuaugaggaguguuccugcuacccggacaccggaacagugaugugugugugcagagauaacuggcacggcucuaaucggcccugggucagcuucaaccagaaucuugacuaccagaucggguauauuugcuccggaguuuuuggcgauaacccucgccccaaggacggggaaggaagcuguaauccugugacgguggauggcgcugacggcgucaaaggguucucuuacaaguauggaaacggcguguggaucgggagaaccaaauccaaucggcugcgcaagggauuugagaugauuugggaccccaacggcuggacaaauaccgauagcgacuucucuguuaaacaagauguggucgccaucacagacugguccggguacagcggcuccuuugugcagcacccggaacucaccggacuggauugcaucagaccuuguuucuggguugagcuugugcggggccugccccgcgaaaacacgacaauuuggaccucugggagcuccaucucuuucugcggagucaacagcggcaccacaaauugguccuggccugacggggcggagcuccccuuuaccauugauaaguga

SEQ ID NO: 204484 - RNA, 1413 nt, Artificial Sequence
  derived and/or modified sequence opt5 from neuraminidase__InfluenzaA__AEX33949
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguugugguggagaaagacaagaccucugucacacuggccggaaacagcucccuuuguagcaucucuggcugggcgauuuacaccaaagauaauuccauccggauugggagcaagggagacguguucguuauccgcgagccuuuuaucucuugcucccaccuggaauguagaacguucuuucucacccaaggcgcucugcuuaacgauaaacauagcaauggcacagugaaggaccggucuccguaucgcgcccugauguccugcccccucggggaggccccuagccccuacaacuccagauucgaaucugucgcuuggagcgccuccgcuugucacgauggaaugggcuggcugaccauugggaucagcggaccugacaacggcgccguggcgguucugaaguauaaugggauuaucacagagaccgugaaaucuuggaagaaacggauucuccgcacgcaggaguccgaaugcgucuguaugaacggaagcugcuuuacaaucaugaccgauggccccucuaauggcgccgcuagcuacaagaucuucaaaauugagaaggggaaggugacaaaaaccaucgaacugaacgccccuaauuuucauuaugaggaguguuccugcuacccggacaccggaacagugaugugugucugcagagauaacuggcacggcucuaaucggcccuggguuagcuucaaccagaaucuugacuaccagauuggguauaucugcuccggaguguuuggcgauaacccucgccccaaggacggggaaggaagcuguaauccugugacggucgauggcgcugacggcgugaaaggguucucuuacaaguauggaaacggcguuuggauugggagaaccaaauccaaucggcugcgcaagggauuugagaugaucugggaccccaacggcuggacaaauaccgauagcgacuucucugugaaacaagaugucguggccauuacagacugguccggguacagcggcuccuuuguucagcacccggaacucaccggacuggauugcaucagaccuuguuucuggguggagcuuguccggggccugccccgcgaaaacacgacaaucuggaccucugggagcuccauuucuuucugcggagugaacagcggcaccgcgaauugguccuggccugacggggccgagcuccccuuuacaaucgauaaguga

SEQ ID NO: 204485 - RNA, 1410 nt, Artificial Sequence
  derived and/or modified sequence opt5 from neuraminidase__InfluenzaA__AEX33971
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaccguguaucugacaaauaccacgaccgagaaggaaaucugcccuaaacucgccgaguaccggaacuggucuaagccccagugugacauuacaggguucgcgccuuuuagcaaagauaauuccauccgccugucugcuggaggcgacauuugggugaccagagagcccuaugucagcugcgauccugacaaguguuaccaauucgcccuugggcagggaacaacccugaacaaugugcauuccaacgauacgguucacgaccggacaccguaucgcacccuccugaugaaugaacugggcgugcccuuucaucucgggacaaagcaggucugcaucgccuggucuagcuccagcugucacgauggaaaggcuuggcugcaugugugcguuaccggcgacgauaaaaacgccaccgcuucuuucaucuacaauggcagacuuguggacuccauugucagcuggucuaaagagauccugcggacacaggaauccgagugugugugcauuaacgggacguguaccguggucaugacagauggaagcgccuccggcaaggcggacaccaaaauccucuuuauugaggaagggaagaucguucacacaucuacccugagcggauccgcccaacacguggaggaaugcagcugcuauccucgcuaccccggcgugagaugugucugccgggauaauuggaaggggucuaaccgcccuaucguggacauuaacaucaaagacuacuccauuguuagcagauauguguguucuggaaucgucggcgauacgccccggaagaaugacagcuccucuagcucccauugccuugauccgaacaaugaggaaggcgggcacggagugaaaggcugggcuuucgacgaugggaacgacguuuggaugggacgcacaauuagcgagaagucuagauccggcuacgagaccuuuaaagugaucgaaggguggagcaauccuaacucuaagcugcagaucaaucggcaggucauuguggaucgcggaaacagauccggcuauagcggcaucuucuccgucgaggggaaaucuuguauuaaucggugcuuuuacguggaacucaucagaggacgcaaggaggaaaccgagguucuguggacaagcaacuccauuguggucuucuguggcaccucugggacauauggaacgggcagcuggcccgacggggccgauaucaaucugaugccuauuuga

SEQ ID NO: 204486 - RNA, 1410 nt, Artificial Sequence
  derived and/or modified sequence opt5 from neuraminidase__InfluenzaA__AEX33993
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcgaggccgacacaaagauccucuuuauugaagaggggaaaaucguccauaccuccacacugucuggaagcgcgcaacacguugaagagugcuccugcuauccuagauaccccggcgugcggugugugugccgcgauaacuggaaggggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgagaaaucuagacucggcuaugaaacauuuaagguuauugaggggugguccaacccuaaaagcaagcugcagaucaaucgccaggugauugucgaucggggaaacagaucuggcuacuccggcaucuucagcguggaagggaaauccuguauuaaucggugcuuuuaugucgagcugaucagaggacgcaaggaagagaccgaggugcucuggaccucuaacagcauuguuguguucuguggcacauccgggaccuacggaacaggcucuuggcccgacggggcugauaucaaucugaugccugucuga

SEQ ID NO: 204487 - RNA, 1410 nt, Artificial Sequence; identical to SEQ ID NO: 199536
  derived and/or modified sequence opt5 from neuraminidase__InfluenzaA__AEX34026

SEQ ID NO: 204488 - RNA, 1410 nt, Artificial Sequence
  derived and/or modified sequence opt5 from neuraminidase__InfluenzaA__AEX34036
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacggccggacgccguaucgcacacuccugaugaaugaacugggggugcccuuucaucucggaaccaagcaggucugcauugccuggucuagcuccagcugucacgacggcaaagccuggcugcaugugugcguuacaggcgaugacaagaacgcuaccgccucuuucaucuacaaugggagacuuguggauuccauugucagcuggucuaaagagauccugcggacccaggaauccgagugugugugcauuaacggaacaugugcuguggucaugacggacggcagcgccuccgggaaggcggauaccaaaauccucuuuaucgaggaaggaaagauuguucacacaucuacccugagcggcuccgcccaacacguggaggaaugcagcugcuauccucgcuaccccggggugagaugugucugccgggacaauuggaagggaucuaaccgcccuaucguggauauuaacaucaaagacuacuccauuguuagcagauauguguguucuggccuugucggcgacacaccccggaagaaugauagcuccucuagcucccauugccuggacccgaacaaugaggaagggggacacggcgugaaagggugggcuuucgaugacggagaugacguuuggaugggccgcaccaucagcgagaagucuagauccggguacgagacguuuaaagugaucgaaggauggagcaacccuaauucuaagcuccagauuaaccggcaggucaucguggaucgcggcaauagauccggcuauagcgggauuuucuccgucgagggaaaaucuuguaucaaccggugcuuuuacguggaacugauuagaggccgcaaggaggaaacagagguucuguggaccagcaauuccaucguggucuucugugggaccucuggaacauauggcaccgggagcuggcccgacggcgccgauauuaaccucaugccuaucuga

SEQ ID NO: 204489 - RNA, 1410 nt, Artificial Sequence
  derived and/or modified sequence opt5 from neuraminidase__InfluenzaA__AEX34058
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucacggaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaggccgacacaaaaauccucuuuaucgaggaagggaagauuguucacaccucuacacugagcggauccgcgcaacacguggaggaaugcagcugcuauccucgcuaccccggcgugagaugugucugccgggauaauuggaaggggucuaaccgcccuaucguggacauuaacaucaaagacuacuccauuguuagcagauauguguguucuggacuugucggcgauacgccccggaagaaugacagcuccucuagcucccauugccuggauccgaacaaugaggaaggcgggcacggagugaaaggcugggccuucgacgaugggaacgacguuuggaugggacgcaccaucagcgagaagucuagauccggcuacgagacauuuaaagugaucgaaggguggagcaauccuaacucuaagcuccagauuaaucggcaggucaucguggaucgcggaaacagauccggcuauagcggcauuuucuccgucgaggggaaaucuuguaucaaucggugcuuuuacguggaacugauuagaggacgcaaggaggaaaccgagguucuguggaccagcaacuccaucguggucuucuguggcacaucugggaccuauggaacaggcagcuggcccgacggggcugauauuaaucucaugccuaucuga

SEQ ID NO: 204490 - RNA, 1410 nt, Artificial Sequence
  derived and/or modified sequence opt5 from neuraminidase__InfluenzaA__AEX34103
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaagugugcccuaaacucgcugaguaccggaacuggucuaagccccagugugacaucaccggguucgccccuuuuagcaaagauaauuccauucgccugucugcgggaggcgacaucugggucacaagagagcccuaugugagcugcgauccugacaaguguuaccaauucgcucuugggcagggaaccacacugaacaauguucauuccaacgauaccgugcacgaccggacgccguaucgcacacuccugaugaaugaacugggcguccccuuucaucucgggaccaaacaggugugcaucgccuggagcagcuccagcugucacgauggaaaggccuggcugcauguuugcgugacaggcgacgauaagaacgcuaccgccucuuucauuuacaauggcagacuugucgacuccaucgugagcuggucuaaagagauucugcggacccaggaauccgagugugugugcaucaacgggacauguacggucguuaugaccgauggaagcgcuuccggcaaggccgacacaaaaauucucuuuaucgaggaagggaagaucgugcacaccucuacacugagcggaaaugcgcaacacguggaggaaugcuccugcuauccucgcuaccccggcgucagaugugugugccgggauaacuggaaggggagcaaccgcccuauuguugacaucaauauuaaagacuacucuaucguguccagauaugucuguagcggacuugugggcgauacgccccggaagaacgacucuagcuccucuagccauugccuggauccgaauaacgaggaaggcgggcacggaguuaaaggcugggccuucgacgaugggaaugacguguggaugggacgcaccauuuccgagaagucuagaucuggcuacgagacauuuaaagucaucgaagggugguccaacccuaauagcaagcuccagaucaaccgccaggugauugucgaucggggaaauagaucuggcuauuccggcaucuucagcguggaggggaaauccuguauuaaccggugcuuuuacguugaacugaucagaggacgcaaggaggaaaccaaggugcuguggaccucuaauagcauugucguguucuguggcacauccgggaccuauggaacaggcucuuggcccgacggggcugauaucaaccucaugccuauuuga

SEQ ID NO: 204491 - RNA, 1410 nt, Artificial Sequence
  derived and/or modified sequence opt5 from neuraminidase__InfluenzaA__AEX34114
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguauccuaccaauacaaccauugagaaggaaaucugccccaaacuggccgaguaccggaacuggucuaagccucagugugacauuacgggguucgcgcccuuuagcaaagauaauuccauccgccucucugcuggaggcgacaucugggugaccagagagccuuaugucagcugcgauccggacaaguguuaccaauucgcccuggggcagggaacaacccuuaacaaugugcauuccaacgauacaguucacgaccggacccccuaucgcacgcugcucaugaaugaacugggcgugccuuuucaucuggggacaaagcaggucugcauugccuggucuagcuccagcugucacgauggaaaggcuuggcuccaugugugcguuaccggcgacgauaaaaacgccacagcuucuuucaucuacaauggcagacugguggacuccauugucagcuggucuaaagagauccuucggacccaggaauccgagugugugugcauuaacgggaccuguacaguggucaugacggauggaagcgccuccggcaaggcggacaccaaaauccuguuuaucgaggaagggaagauuguucacacaucuacccucagcggauccgcccaacacguggaggaaugcagcugcuauccccgcuacccuggcgugagaugugucugccgggauaauuggaaggggucuaaccgccccaucguggacauuaacaucaaagacuacuccauuguuagcagauauguguguucuggacuggucggcgauacaccgcggaagaaugacagcuccucuagcucccauugccuugauccuaacaaugaggaaggcgggcacggagugaaaggcugggcuuucgacgaugggaacgacguuuggaugggacgcaccaucagcgagaagucuagauccggcuacgagacguuuaaagugaucgaaggguggagcaaucccaacucuaagcugcagauuaaucggcaggucaucguggaucgcggaaacagauccggcuauagcggcauuuucuccgucgaggggaaaucuuguaucaaucggugcuuuuacguggaacucauuagaggacgcaaggaggaaacagagguucuguggaccagcaacuccaucguggucuucuguggcaccucugggacauauggaaccggcagcuggccugacggggccgauauuaaucugaugcccaucuga

SEQ ID NO: 204492 - RNA, 1410 nt, Artificial Sequence
  derived and/or modified sequence opt5 from neuraminidase__InfluenzaA__AEX34137
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggggccgcacgccguauagaacacuccugaugaacgaacugggggugcccuuucaccucggaaccaagcaggucugcauugccugguccucuagcuccugucaugacggcaaagccuggcugcacgugugcaucacaggcgaugacaagaaugcuaccgccagcuucauuuacaacgggcggcuuguugauucuaucguguccuggagcaaagagauucugcgcacccaggaaucugagugugucugcaucaauggaacauguacgguggugaugaccgacggcuccgcuagcgggaaggccgauacaaaaauccucuuuauugaggaaggaaagaucguccauaccuccacacugucuggcagcgcgcaacacguugaggaaugcuccugcuauccuagauaccccggggugcggugugugugccgcgacaacuggaagggaagcaacagaccuauugucgauaucaauauuaaagaccacucuaucguguccagcuacguuuguucuggccuugugggcgacacgccccggaagaacgauagcuccucuagcucccauugccuggacccgaauaacgaggaagggggacacggcgucaaagggugggccuucgaugacggaaaugauguguggaugggccgcaccaucagcgagaagucuagacucggguaugagacauuuaaaguuauugaaggaugguccaacccuaagagcaaacugcagaucaaucgccaggugauugucgaccggggcaacagaucuggcuacuccgggaucuucagcguggagggaaaguccuguauuaaucggugcuuuuaugucgaacugaucagaggccgcaaggaggaaaccgaggugcucuggaccucuaacagcauuguuguguucugugggacauccggaaccuacggcacagggucuuggcccgauggcgcugacaucaaucugaugccuaucuga

SEQ ID NO: 204493 - RNA, 1410 nt, Artificial Sequence
  derived and/or modified sequence opt5 from neuraminidase__InfluenzaA__AEX34191
augaaccccaaucagaagaucauuaccaucggcagcgugucccugucuauuagcacaaucugcuucuuuaugcaaauugccauccucaucacgaccgucacacugcacuucaaacaguacgaguuuaacuccucuccuaauaaccagguuaugcuuugugaaccgaccauuaucgagagaaauauuacagaaaucguguaucugaccaacacaaccauugagaaggaaaucugccccaaacucgcugaguaccggaauuggagcaagccucagugugacauuacgggguucgcccccuuuuccaaagauaacucuauccgccugagcgcgggaggcgacaucugggugaccagagagccuuaugucuccugcgaucccgacaaguguuaccaauucgcucuugggcagggaacaacccugaauaacgugcauagcaauaacacaguucgggaucgcaccccuuauagaacgcuccugaugaaugaacugggcgugccguuucaccucgggacaaagcaggucugcauugccuggucuuccagcucuugucaugacggaaaagccuggcugcacgugugcaucaccggcgaugacaagaacgcuacagccuccuucauuuacaauggccggcuuguugauagcaucgugucuugguccaaagagauucugcgcacccaggaaagcgagugugucugcaucaacgggaccuguacaguggugaugacggacggauccgcuucuggcaaggccgauaccaaaauccucuuuauugaggaagggaagaucguccauacaagcacccuguccggaagcgcgcaacacguugaggaaugcucuugcuaucccagauacccuggcgugcggugugugugccgcgacaacuggaagggguccaauagacccauugucgauaucaacauuaaagaccacagcaucgugucuagcuacguuuguuccggacuugugggcgacacaccucggaagaaugauucuagcuccagcucucauugccuggaccccaacaaugaggaaggcgggcacggagucaaaggcugggccuucgaugacgggaacgauguguggaugggacgcaccaucuccgaaaagagcagacucggcuaugagacguuuaaaguuauugagggguggucuaauccgaaguccaaacugcagaucaaccgccaggugauugucgaccggggaaauagaagcggcuacuccggcaucuucucuguggagggaaagagcuguauuaaccggugcuuuuaugucgaacugaucagagggcgcaaggaggaaacagaggugcucuggaccuccaauucuauuguuguguucuguggcaccagcgggacauacggaaccggcuccuggccugauggggcugacaucaaccugaugcccaucuga

SEQ ID NO: 204494 - RNA, 1410 nt, Artificial Sequence
  derived and/or modified sequence opt5 from neuraminidase__InfluenzaA__AEX34224
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacggccggacgccguaucgcacacuccugaugaaugaacugggggugcccuuucaucucggaaccaagcaggucugcauugccuggucuagcuccagcugucacgacggcaaagccuggcugcaugugugcguuacaggcgaugacaagaacgcuaccgccucuuucaucuacaaugggagacuuguggauuccauugucagcuggucuaaagagauccugcggacccaggaauccgagugugugugcauuaacggaacauguacgguggucaugaccgacggcagcgcuuccgggaaggccgauacaaaaauccucuuuaucgaggaaggaaagauuguucacaccucuacacugagcggcuccgcgcaacacguggaggaaugcagcugcuauccucgcuaccccggggugagaugugucugccgggacaauuggaagggaucuaaccgcccuaucguggauauuaacaucaaagacuacuccauuguuagcagauauguguguucuggccuugucggcgacacgccccggaagaaugauagcuccucuagcucccauugccuggacccgaacaaugaggaagggggacacggcgugaaagggugggccuucgaugacggaaacgauguuuggaugggccgcaccaucagcgagaagcucagaucuggguacgagacauuuaaagugaucgaaggaugguccaauccuaacagcaagcugcagauuaaucggcaggucaucguggaccgcggcaacagaucuggcuauuccgggauuuucagcgucgagggaaaauccuguaucaaucggugcuuuuacguggaacugauuagaggccgcaaggaggaaaccgagguucucuggaccucuaacagcaucguggucuucugugggacauccggaaccuauggcacagggucuuggcccgauggcgcugacauuaaucugaugccuaucuga

SEQ ID NO: 204495 - RNA, 1410 nt, Artificial Sequence
  derived and/or modified sequence opt5 from neuraminidase__InfluenzaA__AEX34235
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacgaccggaccccguaucgcacgcuccugaugaaugaacugggcgugcccuuucaucucgggacaaagcaggucugcauugccuggucuagcuccagcugucacgauggaaaggcuuggcugcaugugugcguuaccggcgacgauaagaacgccacagcuucuuucaucuacaauggcagacuuguggacuccauugucagcuggucuaaagagauccugcggacccaggaauccgagugugugugcauuaacgggaccuguacaguggucaugacggauggaagcgccuccggcaaggcggacaccaaaauccucuuuaucgaggaagggaagauuguucacacaucuacccugagcggauccgcccaacacguggaggaaugcagcugcuauccucgcuaccccggcgugagaugugucugccgggauaauuggaaggggucuaaccgcccuaucguggacauuaacaucaaagacuacuccauuguuagcagauauguguguucuggacuugucggcgauacaccccggaaaagcgacuccucuagcuccagccauugccuggauccgaauaacgaggaaggcgggcacggagugaaaggcugggcuuucgacgaugggaaugacguuuggaugggacgcaccaucucugagaaguccagaagcggcuacgagacguuuaaagugaucgaaggguggucuaacccuaauuccaagcuccagauuaaccggcaggucaucguggaucgcggaaauagaagcggcuauuccggcauuuucucugucgaggggaaaagcuguaucaaccggugcuuuuacguggaacugauuagaggacgcaaggaggaaacagagguucuguggaccuccaauucuaucguggucuucuguggcaccagcgggacauauggaaccggcuccuggcccgacggggccgauauuaaccucaugccuaucuga

SEQ ID NO: 204496 - RNA, 1410 nt, Artificial Sequence
  derived and/or modified sequence opt5 from neuraminidase__InfluenzaA__AEX34246
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggggccgcacgccguauagaacacuccugaugaacgaacugggggugcccuuucaccucggaaccaagcaggucugcauugccugguccucuagcuccugucaugacggcaaagccuggcugcacgugugcaucacaggcgaugacaagaaugcuaccgccagcuucauuuacaacgggcggcuuguugauucuaucguguccuggagcaaagagauucugcgcacccaggaaucugagugugucugcaucaauggaacauguacgguggugaugaccgacggcuccgcuagcgggaaggccgauacaaaaauccucuuuauugaggaaggaaagaucguccauaccuccacacugucuggcagcgcgcaacacguugaggaaugcuccugcuauccuagauaccccggggugcggugugugugccgcgacaacuggaagggaagcaacagaccuauugucgauaucaauauuaaagaccacucuaucguguccagcuacguuuguucuggccuugugggcgacacgccccggaagaacgauagcuccucuagcucccauugccuggacccgaauaacgaggaagggggacacggcgucaaagggugggccuucgaugacggaaaugauguguggaugggccgcaccaucagcgagaagucuagacucggguaugagacauuuaaaguuauugaaggaugguccaacccuaagagcaaacuccaggugaaucggcaggucaucguggaccgcggcaacagaucuggcuacuccgggauuuucagcgucgagggaaaguccuguaucaaucggugcuuuuauguggaacugauuagaggccgcaaggaggaaaccgagguucuguggaccucuaacagcaucguggucuucugugggacauccggaaccuacggcacagggucuuggcccgauggcgcugacauuaaucugaugccuaucuga

SEQ ID NO: 204497 - RNA, 1410 nt, Artificial Sequence
  derived and/or modified sequence opt5 from neuraminidase__InfluenzaA__AEX34257
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucggaaucgcacgccuuauagaacacuccugaugaacgaacugggcgugccguuucaccucgggaccaagcaggucugcauugccuggucuagcuccagcugucaugauggaaaagccuggcugcacgugugcaucacaggcgacgauaagaaugcuaccgccucuuucauuuacaacggccggcuuguugacuccaucgugagcuggucuaaagagauucugcgcacccaggaauccgagugugucugcaucaacgggacauguacgguggugaugaccgauggaagcgcuuccggcaaggccgacacaaaaauccucuuuauugaggaagggaagaucguccauaccucuacacugagcggauccgcgcaacacguugaggaaugcagcugcuaucccagauacccuggcgugcggugugugugccgcgauaauuggaaggggucuaacagacccauugucgacaucaauauuaaagaucacuccaucgugagcucuuacguuuguagcggacuugugggcgacaccccucggaagaacgacuccucuagcuccagccauugccuggaucccaauaacgaggaaggcgggcacggagucaaaggcugggccuucgacgaugggaaugacguguggaugggacgcacgaucucugagaaguccagacucggcuaugagacauuuaaaguuauugaaggguggagcaacccgaagucuaaacugcagaucaaucgccaggugauugucgaucggggaaacagauccggcuacagcggcaucuucuccguggaggggaagucuuguauuaaucggugcuuuuaugucgaacugaucagaggacgcaaggaggaaaccgaggugcucuggaccagcaacuccauuguuguguucuguggcacaucugggaccuacggaacaggcagcuggccugacggggcugauaucaaucugaugcccaucuga

SEQ ID NO: 204498 - RNA, 1410 nt, Artificial Sequence
  derived and/or modified sequence opt5 from neuraminidase__InfluenzaA__AEX34268
augaaccccaauaagaaaaucauuaccaucggcagcgugucccugacaauuucuacgaucugcuucuuuaugcagauugccauccucaucaccacagucacccugcacuucaagcaauacgaguuuaacagcccuccgaauaaccagguuaugcuuugugaacccacaauuaucgagagaaauauuaccgaaaucguguaucugacaaacaccacgauugagaaagaaaucugcccuaagcucgcugaguaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaguucgcucuugggcaaggaaccacacugaauaacgugcauagcaaugauaccguucggaaccgcacgccguauagaacacuccugaugaaugaacugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggccggcuuguugauucuaucguguccuggagcaaggagauucugcgcacccaggaaucugagugugucugcaucaacgggacauguacgguggugaugaccgacggauccgcuagcggcaaagccgauacaaagauccucuuuauugaggaagggaagaucguccauaccuccaaacugucuggaagcgcgcagcacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacaccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacguuuaaaguuauugaagggugguccaauccuaagagcaagcugcaaaucaaccgccaggugauugucgaccggggaaauagaucuggcuacuccggcaucuucagcguggaggggaaauccuguauuaaccggugcuuuuaugucgaacugaucagaggacgcaaggaggaaacagaggugcucuggaccucuaauagcauuguuguguucuguggcaccuccgggacauacggaaccggcucuuggcccgauggggcugacaucaaccugaugccuaucuga

SEQ ID NO: 204499 - RNA, 1410 nt, Artificial Sequence
  derived and/or modified sequence opt5 from neuraminidase__InfluenzaA__AEX34278
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacgaccggaccccguaucgcacgcuccugaugaaugaacugggcgugcccuuucaucucgggacaaagcaggucugcauugccuggucuagcuccagcugucacgauggaaaggcuuggcugcaugugugcguuaccggcgacgauaaaaacgccacagcuucuuucaucuacaauggcagacuuguggacuccauugucagcuggucuaaagagauccugcggacccaggaauccgagugugugugcauuaacgggaccuguacaguggucaugacggauggaagcgccuccggcaaggcggacaccaaaauccucuuuaucgaggaagggaagauuguucacacaucuacccugagcggauccgcccaacacguggaggaaugcagcugcuauccucgcuaccccggcgugagaugugucugccgggauaauuggaaggggucuaaccgcccuaucguggacauuaacaucaaagacuacuccauuguuagcagauauguguguucuggacuugucggcgauacaccccggaagaaugacagcuccucuagcucccauugccuggauccgaacaaugagaaaggcgggcacggagugaagggcugggcuuucgacgaugggaacgacguuuggaugggacgcaccaucagcgaaaaaucuagauccggcuacgagacguuuaaggugaucgagggguggagcaauccuaacucuaaacuccagauuaaucggcaggucaucguggaucgcggaaacagauccggcuauagcggcauuuucuccgucgaagggaagucuuguaucaaucggugcuuuuacguggagcugauuagaggacgcaaggaagagacagaaguucuguggaccagcaacuccaucguggucuucuguggcaccucugggacauauggaaccggcagcuggcccgacggggccgauauuaaucucaugccuaucuga

SEQ ID NO: 204500 - RNA, 1413 nt, Artificial Sequence
  derived and/or modified sequence opt5 from neuraminidase__InfluenzaA__AEX34310
augaaccccaaucagaagaucauuaccaucggcagcauuuccaucgccauugggaucaucucucugaugcuccaaauuggaaacaucauuagcaucugggcuucccacucuauucagacaggcacgcagaaucauaccgggaucugcaaccagagaauuaucacauacgagaauagcaccugggugaaccacacauaugucaauaucaacaauaccaacguuguggccggaaaagacaagacaccugugacccuggucggcaauuccucucuuuguagcauuuccgggugggcgaucuacacgaaagauaacagcauucggaucggaucuaagggcgacguguucguuauucgcgaaccguuuaucuccugcagccaucuggaguguaaaaccuucuuucucacacaaggcgcucugcuuaaugauaagcacucuaacgggaccgugaaggacagaucccccuaucgggcccugaugagcugcccucucggagaagcccccucuccuuacaauuccaaauucgagagcgucgcuugguccgccucugcuugucaugauggcaucggguggcugacaauuggaaucagcggccccgacaacggggccguggcgguucugaaguauaaaggaauuaucaccggcacgauuaaguccuggaaaaagcagauccuccgcacacaggaaagcgagugcguguguaugaacggcucuugcuuuaccaucaugacagaugggccuuccaauggagccgcuagcuacaagauuuucaaaaucgagaagggcaaagucaccaagucuauggaacugaacgccccgaauuuucacuaugaggaauguagcugcuaccccgacaccgggacagugaugugugugugcagagauaacuggcacggauccaaucggccuugggucucuuucaaccagaaucuugacuaccaaauuggcuauaucugcagcgggguuuuuggagauaacccccgcccuaaagacagagagggcuccuguaaucccgugacgguggauggcgcuaacggggucaagggauucagcuacaaauauggcaaugggguguggauuggacggaccaagucuaaccgcaucagaaagggcuuugagaugauuugggacccgaauggguggacaaacaccgacuccgauuucagcguuaaacaggacaucguggccaucacagauuggucuggcuacuccggcagcuuuguccagcauccugaacugaccggacucgacugcauucggcccuguuucuggguggagcugguucgcgggcuuccuggagaaaauacgacaaucuggaccuccggcucuagcauuuccuucugcggggugaacggagauaucgcgaacuggucuuggcccgacggcgccgagcugcccuuuaccauugauaaguga

SEQ ID NO: 204501 - RNA, 1413 nt, Artificial Sequence
  derived and/or modified sequence opt5 from neuraminidase__InfluenzaA__AEX34321
augaaccccaaucagaagaucauuaccaucggcagcauuuccaucgccauugggaucaucucucugaugcuccaaauuggaaacaucauuagcaucugggugucccacucuauucagacaggcagccagaauaacacggggaucugcaaucagagaauuaucaccuacgagaacuccacaugggucaaucauaccuauguuaacaucaauaacacaaaugugguggcuggagaagacaaaaccucugucacacuggccggcaacagcucccuuuguagcauuucugggugggcgaucuacaccaaggauaauuccauucggaucggaagcaaaggcgacguguucguuauucgcgagccuuuuaucucuugcucccaccuggaauguagaacguucuuucucacccaaggcgcucugcuuaacgauaagcauagcaaugggacagugaaagaccggucuccguaucgcgcccugauguccugcccccucggagaggccccuagccccuacaacuccaaguucgaaucugucgcuuggagcgccuccgcuugucacgauggcaugggguggcugaccaucggaauuagcggcccugacaacggggccguggcgguucugaaguauaauggaaucauuacaggcaccaucaaaucuuggaagaaacagauucucagaacgcaggaguccgagugcguguguaugaacggcagcugcuuuacaaucaugaccgaugggcccucuaauaaggccgcuagcuacaaaaucuucaagauugaaaagggaaaagucacaaaguccaucgagcugaacgccccuaauuuuuauuacgaagaguguucuugcuacccggacaccggcauugugaugugugugugccgggauaacuggcaugggagcaaucgccccugggucuccuucaaccagaaucuugacuaucaaaucggauacauuugcagcggcguuuuuggggauaacccuagacccgaggacggagaaggcucuuguaauccugugaccguggauggcgcuaacggggucaaaggauucuccuauaaguacggcaaugggguguggaucggacggacaaaaagcaaccgccugagaaagggcuuugagaugauuugggaccccaauggguggacgaacaccgacucugauuucuccguuaaacaggacguggucgccaucacagauuggagcggcuauuccggaucuuuugugcagcacccggaacucaccggccuggacugcauccggccuuguuucuggguugagcuugugcgcgggcugcccagagaaaacacaaccauuuggacgagcggauccucuaucagcuucugcggcgucaauuccgauacagcgaacuggagcuggccugacggggccgagcuccccuuuaccauugauaaguga

SEQ ID NO: 204502 - RNA, 1410 nt, Artificial Sequence; identical to SEQ ID NO: 199081
  derived and/or modified sequence opt5 from neuraminidase__InfluenzaA__AEX34356

SEQ ID NO: 204503 - RNA, 1410 nt, Artificial Sequence
  derived and/or modified sequence opt5 from neuraminidase__InfluenzaA__AEX34367
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgaagcacguugaggaaugcuccugcuauccuagacaccccggcgugcggugugugugccgcgauaacuggaaagggagcaacagaccuauugucgacaucaauauuaaggaccauucuaucguguccagcuacguuuguucuggacuugugggcgauacgccccggaaaaacgacagcuccucuagcucccacugccuggauccgaauaacgaggaaggcgggcauggagucaagggcugggccuucgacgaugggaaugacguguggaugggacgcaccaucagcgagaaaucuagacucggcuacgagacauuuaagguuauugaagggugguccaacccuaaaagcaagcugcaaaucaaucgccaggugauugucgaucggggaaacagaucuggcuauuccggcaucuucagcguggaggggaaguccuguauuaaucggugcuuuuacgucgaacugaucagaggacgcaaagaggaaaccgaggugcucuggaccucuaacagcauuguuguguucuguggcacauccgggaccuauggaacaggcucuuggcccgacggggcugauaucaaucugaugccuaucuga

SEQ ID NO: 204504 - RNA, 1410 nt, Artificial Sequence
  derived and/or modified sequence opt5 from neuraminidase__InfluenzaA__AEX34378
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaucucgcugaguaccggaacugguccaaaccccagugugacauuaccggguucgccccuuuuucuaaggauaauagcauccgccuguccgcgggaggcgacaucugggugacaagagagcccuaugucucuugcgauccugacaaauguuaccaauucgcucuugggcagggaaccacacugaacaaugugcauagcaacgauaccguucgggaccgcacgccguauagaacacuccugaugaaugaacugggcgugcccuuucaccucgggaccaagcaggucugcauugccugguccucuagcuccugucaugauggaaaggccuggcugcacgugugcaucacaggcgacgauaaaaacgcuaccgccagcuucauuuacaauggccggcuuguugacucuaucguguccuggagcaaggagauucugcgcacccaggaaucugagugugucugcaucaacgggacauguacgguggugaugaccgauggauccgcuagcggcaaagccgacacaaagauccucuuuauugaggaagggaaaaucguccauaccuccacacugucuggaagcgcgaagcacguugaggaaugcuccugcuauccuagacaccccggcgugcggugugugugccgcgauaacuggaaggggagcaauagaccuauugucgacaucaacauuaaagaccauucuaucguguccagcuacguuuguucuggacuugugggcgauacgccccggaagaaugacagcuccucuagcucccacugccuggauccgaacaaugaggaaggcgggcauggagucaaaggcugggccuucgacgaugggaacgacguguggaugggacgcaccaucagcgagaagucuagacucggcuacgagacauuuaaaguuauugaagggugguccaauccuaagagcaaacugcaaaucaaccgccaggugauugucgaucggggaaauagaucuggcuauuccggcaucuucagcguggaggggaaguccuguauuaaccggugcuuuuacgucgaacugaucagaggacgcaaggaggaaaccgaggugcucuggaccucuaauagcauuguuguguucuguggcacauccgggaccuauggaacaggcucuuggcccgacggggcugauaucaaccugaugccuaucuga

SEQ ID NO: 204505 - RNA, 1410 nt, Artificial Sequence
  derived and/or modified sequence opt5 from neuraminidase__InfluenzaA__AEX34400
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggggccgcacgccguauagaacacuccugaugaacgaacugggggugcccuuucaccucggaaccaagcaggucugcauugccugguccucuagcuccugucaugacggcaaagccuggcugcacgugugcaucacaggcgaugacaagaaugcuaccgccagcuucauuuacaacgggcggcuuguugauucuguggucuccuggagcaaagagauccugcgcacccaggaaucugagugugugugcauuaauggaacauguacgguggucaugaccgacggcuccgcuagcgggaaggccgauacaaaaauccucuuuaucaaggagggaaagauuguucauaccuccacacugucuggcagcgcgcaacacguggaagagugcuccugcuauccuagauaccccggggugcggugugucugccgcgacaacuggaaaggaagcaacagaccuaucguggauauuaauaucaaggaccacucuauuguuuccagcuacguguguucuggccuugucggcgacacgccccggaaaaacgauagcuccucuagcucccauugccuggacccgaauaacgaagaagggggacacggcgugaaggggugggccuucgaugacggaaaugauguuuggaugggccgcaccaucagcgagaaaucuagacucggguaugagacauuuaaggugaucgagggaugguccaacccuaaaagcaagcugcagauuaaucggcaggucaucguggaccgcggcaacagaucuggcuacuccgggauuuucagcgucgaaggaaaguccuguaucaaucggugcuuuuauguggagcugauuagaggccgcaaagaagagaccgaaguucucuggaccucuaacagcaucguggucuucugugggacauccggaaccuacggcacagggucuuggcccgauggcgcugacauuaaucugaugccuaucuga

SEQ ID NO: 204506 - RNA, 1413 nt, Artificial Sequence
  derived and/or modified sequence opt5 from neuraminidase__InfluenzaA__AEX34432
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguugugguggagaaagacaagaccucugucacacuggccggaaacagcucccuuuguagcaucucuggcugggcgauuuacaccaaagauaauuccauccggauugggagcaagggagacguguucguuauccgcgagccuuuuaucucuugcucccaccuggaauguagaacguucuuucucacccaaggcgcucugcuuaacgauaaacauagcaauggcacagugaaggaccggucuccguaucgcgcccugauguccugcccccucggggaggccccuagccccuacaacuccagauucgaaucugucgcuuggagcgccuccgcuugucacgauggaaugggcuggcugaccauugggaucagcggaccugacaacggcgccguggcgguucugaaguauaaugggauuaucacagagaccauuaaaucuuggaagaaacggauccuccgcacgcaggaguccgaaugcguguguaugaacggaagcugcuuuacaaucaugaccgauggccccucuaauggcacagccagcuacaagauuuucaaaaucgagaaggggaaggucaccaaaaccauugaacugaacgcuccuaauuuucauuaugaggaguguuccugcuacccggacacaggaacggugaugugugugugcagagauaacuggcacggcucuaaucggcccugggucagcuucaaccagaaucuugacuaccagaucggguauauuugcuccggaguuuuuggcgauaacccucgccccaaggacggggaaggaagcuguaauccugugaccguggauggcgccgacggcgucaaaggguucucuuacaaguauggaaacggcguguggaucgggagaacaaaauccaaucggcugcgcaagggauuugagaugauuugggaccccaacggcuggaccaauacagauagcgacuucucuguuaaacaagauguggucgcuaucaccgacugguccggguacagcggcuccuuugugcagcacccggaacucacgggacuggauugcaucagaccuuguuucuggguugagcuugugcggggccugccccgcgaaaacacaaccauuuggaccucugggagcuccaucucuuucugcggagucaacagcggcacagccaauugguccuggccugacggggcggagcuccccuuuaccauugauaaguga

SEQ ID NO: 204507 - RNA, 1413 nt, Artificial Sequence; identical to SEQ ID NO: 204506
  derived and/or modified sequence opt5 from neuraminidase__InfluenzaA__AEX34443

SEQ ID NO: 204508 - RNA, 1410 nt, Artificial Sequence; identical to SEQ ID NO: 199627
  derived and/or modified sequence opt5 from neuraminidase__InfluenzaA__AEX34454

SEQ ID NO: 204509 - RNA, 1413 nt, Artificial Sequence
  derived and/or modified sequence opt5 from neuraminidase__InfluenzaA__AEX34465
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugugaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacgggauuaagggauucuccuacaaauauggcaauggggucuggaucggacgcacgaaguccaacagacugcggaaaggcuuugaaaugauuugggaccccaauggguggaccgauacagacucugauuucuccgugaagcaagacguuguggcgaucaccgauuggagcggcuacuccggaucuuuuguccagcauccggagcucacaggccuggacugcaugcgcccuuguuucuggguggaacuuguuagagggcugccccgggagaacaccacgaucuggacaagcggauccucuauuagcuucugcggcgucaauuccgauaccgccaacuggagcuggccugacggggcugaacuccccuuuaccaucgauaaguga

SEQ ID NO: 204510 - RNA, 1413 nt, Artificial Sequence; identical to SEQ ID NO: 204463
  derived and/or modified sequence opt5 from neuraminidase__InfluenzaA__AEX34476

SEQ ID NO: 204511 - RNA, 1413 nt, Artificial Sequence; identical to SEQ ID NO: 204465
  derived and/or modified sequence opt5 from neuraminidase__InfluenzaA__AEX34487

SEQ ID NO: 204512 - RNA, 1413 nt, Artificial Sequence; identical to SEQ ID NO: 204465
  derived and/or modified sequence opt5 from neuraminidase__InfluenzaA__AEX34498

SEQ ID NO: 204513 - RNA, 1413 nt, Artificial Sequence; identical to SEQ ID NO: 204465
  derived and/or modified sequence opt5 from neuraminidase__InfluenzaA__AEX34509

SEQ ID NO: 204514 - RNA, 1413 nt, Artificial Sequence; identical to SEQ ID NO: 204465
  derived and/or modified sequence opt5 from neuraminidase__InfluenzaA__AEX34520

SEQ ID NO: 204515 - RNA, 1413 nt, Artificial Sequence; identical to SEQ ID NO: 204465
  derived and/or modified sequence opt5 from neuraminidase__InfluenzaA__AEX34531

SEQ ID NO: 204516 - RNA, 1413 nt, Artificial Sequence; identical to SEQ ID NO: 204465
  derived and/or modified sequence opt5 from neuraminidase__InfluenzaA__AEX34542

SEQ ID NO: 204517 - RNA, 1413 nt, Artificial Sequence; identical to SEQ ID NO: 204465
  derived and/or modified sequence opt5 from neuraminidase__InfluenzaA__AEX34553

SEQ ID NO: 204518 - RNA, 1413 nt, Artificial Sequence; identical to SEQ ID NO: 204465
  derived and/or modified sequence opt5 from neuraminidase__InfluenzaA__AEX34564

SEQ ID NO: 204519 - RNA, 1413 nt, Artificial Sequence; identical to SEQ ID NO: 204465
  derived and/or modified sequence opt5 from neuraminidase__InfluenzaA__AEX34575

SEQ ID NO: 204520 - RNA, 1413 nt, Artificial Sequence; identical to SEQ ID NO: 204465
  derived and/or modified sequence opt5 from neuraminidase__InfluenzaA__AEX34586

SEQ ID NO: 204521 - RNA, 1413 nt, Artificial Sequence; identical to SEQ ID NO: 204465
  derived and/or modified sequence opt5 from neuraminidase__InfluenzaA__AEX34597

SEQ ID NO: 204522 - RNA, 1413 nt, Artificial Sequence; identical to SEQ ID NO: 204465
  derived and/or modified sequence opt5 from neuraminidase__InfluenzaA__AEX34608

SEQ ID NO: 204523 - RNA, 1413 nt, Artificial Sequence; identical to SEQ ID NO: 204465
  derived and/or modified sequence opt5 from neuraminidase__InfluenzaA__AEX34619

SEQ ID NO: 204524 - RNA, 1413 nt, Artificial Sequence; identical to SEQ ID NO: 204465
  derived and/or modified sequence opt5 from neuraminidase__InfluenzaA__AEX34630

SEQ ID NO: 204525 - RNA, 1413 nt, Artificial Sequence; identical to SEQ ID NO: 204465
  derived and/or modified sequence opt5 from neuraminidase__InfluenzaA__AEX34641

SEQ ID NO: 204526 - RNA, 1413 nt, Artificial Sequence
  derived and/or modified sequence opt5 from neuraminidase__InfluenzaA__AEX34653
augaaccccaaucagaagaucauuaccaucggcagcauuuccaucgccauugggaucaucucucugaugcuccaagugggaaacauuaucagcauuugggcuucccacucuauccagacaggcagccagaaucauacggggauuugcaaccagagaaucauuaccuacgaaaauuccacaugggucaaccacaccuauguuaauaucaacaauacaaacgugguggccggaaaagacaagaccucugucgcgcuggcuggcaauagcucccuuuguagcaucucugggugggccauuuacacaaaagauaacuccauccggauuggaagcaagggcgacguguucguuauccgcgagccuuuuauuucuugcucccaucuggaguguagaaccuucuuucucacgcaaggcgcccugcuuaaugauaaacacagcaacgggaccgugaaggaccggucuccguaucgcgcucugauguccugcccccucggagaagccccuagccccuacaauuccaaguucgagucugucgcuuggagcgccuccgcgugucaugauggccugggguggcugacaaucggaaucagcggcccugacaacggggccguggcuguucucaaauauaacggaauuaucaccgaaacaauuaagucuuggaaaaagagaauccugcggacccaggaguccgagugcgugugugucaauggcagcugcuuuacgauuaugacagauggccccucuaacggggccgcuagcuacaaaaucuucaagaucgaaaagggacaggugaccaaauccguggagcuuaaugccccuaacuuucacuaugaagaguguucuugcuacccggacacaggcaccgucauguguguuugccgcgauaauuggcacgggagcaacagacccuggguguccuucaaucaggaccuggauuaccaaauuggauauaucugcagcggcguguuuggggacaacccucggcccaaggauggaaaaggcucuuguaauccugucaccguggacggcgcggacgggguuaagggauucuccuacaaauauggcaacgggguguggauuggacgcacaaagagcaauagacuccggaaaggcuuugagaugaucugggaucccaacggguggacggacaccgauucugacuucuccgucaagcaggaugugguugccauuacagacuggagcggcuacuccggaucuuuugugcagcauccggaacugaccggccuugauugcauccgcccuuguuucugggucgagcuggugagagggcucccccgggaaaauacaaccauuuggacgagcggauccucuaucagcuucugcggcgucgacuccgauacagcuaacuggagcuggccugacggggccgagcugcccuuuaccaucgauaaguga

SEQ ID NO: 204527 - RNA, 1413 nt, Artificial Sequence
  derived and/or modified sequence opt5 from neuraminidase__InfluenzaA__AEX34664
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaagucccgcgagcugaaugcuccuaacuuucacuaugaagaguguucuugcuacccggacaccggcaccgugaugugugugugcagagauaauuggcacgggagcaaccggcccugggucuccuucaaucagaaccuugacuaccagaucggauauauuugcagcggcguuuuuggggauaauccucgccccaaagacggaaagggcucuuguaacccugugacagccgauggcgcggacggggugaaaggauucuccuacaaguauggcaauggggucuggaucggaagaacgaaaagcaaccggcugcgcaagggcuuugagaugauuugggaccccaauggguggaccgauacagacucugauuucuccgugaagcaagacguuguggccaucaccgauuggagcggcuacuccggaucuuuuguccagcauccggaacucacaggccuggacugcauuagaccuuguuucuggguggagcuuguucgggggcugccccgcgaaaacaccacgaucuggacaagcggauccucuaucagcuucugcggcguggauuccgacaccgcuaauuggagcuggccugauggggccgagcuccccuuuaccauugacaaauga

SEQ ID NO: 204528 - RNA, 1413 nt, Artificial Sequence; identical to SEQ ID NO: 204506
  derived and/or modified sequence opt5 from neuraminidase__InfluenzaA__AEX34686

SEQ ID NO: 204529 - RNA, 1413 nt, Artificial Sequence
  derived and/or modified sequence opt5 from neuraminidase__InfluenzaA__AEX34760
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguugugguggagaaagacaagaccucugucacacuggccggaaacagcucccuuuguagcaucucuggcugggcgauuuacaccaaagauaauuccauccggauugggagcaagggagacguguucguuauccgcgagccuuuuaucucuugcucccaccuggaauguagaacguucuuucucacccaaggcgcucugcuuaacgauaaacauagcaauggcacagugaaggaccggucuccguaucgcgcccugauguccugcccccucggggaggccccuagccccuacaacuccagauucgaaucugucgcuuggagcgccuccgcuugucacgauggaaugggcuggcugaccauugggaucagcggaccugacaacggcgccguggcgguucugaaguauaaugggauuaucacagagaccauuaaaucuuggaagaaacggauccuccgcacgcaggaguccgaaugcguguguaugaacggaagcugcuuuacaaucaugaccgauggccccucuaauggcgccgcuagcuacaagauuuucaaaaucgagaaggggaaggucacaaaaaccauugaacugaacgccccuaauuuucauuaugaggaguguuccugcuacccggacaccggaacagugaugugugugugcagagauaacuggcacggcucuaaucggcccugggucagcuucaaccagaaucuugacuaccagaucggguauauuugcuccggaguuuuuggcgauaacccucgccccaaggacggggaaggaagcuguaauccugugacgguggauggcgcugacggcgucaaaggguucucuuacaaguauggaaacggcguguggaucgggagaaccaaauccaaucggcugcgcaagggauuugagaugauuugggaccccaacggcuggacaaauaccgauagcgacuucucuguuaaacaagauguggucgccaucacagacugguccggguacagcggcuccuuugugcagcacccggaacucaccggacuggauugcaucagaccuuguuucuggguugagcuugugcggggccugccccgcgaaaacacgacaauuuggaccucugggagcuccaucucuuucugcggagucaacagcggcaccgugaauugguccuggccugacggggcggagcuccccuuuacaauugauaaguga

SEQ ID NO: 204530 - RNA, 1413 nt, Artificial Sequence
  derived and/or modified sequence opt5 from neuraminidase__InfluenzaA__AEX34771
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguugugguggagaaagacaagaccucugucacacuggccggaaacagcucccuuuguagcaucucuggcugggcgauuuacaccaaagauaauuccauccggauugggagcaagggagacguguucguuauccgcgagccuuuuaucucuugcucccaccuggaauguagaacguucuuucucacccaaggcgcucugcuuaacgauaaacauagcaauggcacagugaaggaccggucuccguaucgcgcccugauguccugcccccucggggaggccccuagccccuacaacuccagauucgaaucugucgcuuggagcgccuccgcuugucacgauggaaugggcuggcugaccauugggaucagcggaccugacaacggcgccguggcgguucugaaguauaaugggauuaucacagagaccauuaaaucuuggaagaaacggauccuccgcacgcaggaguccgaaugcguguguaugaacggaagcugcuuuacaaucaugaccgauggccccucuaauggcgccgcuagcuacaagauuuucaaaaucgagaaggggaaggucacaaaaaccauugaacugaacgccccuaauuuucauuaugaggaguguuccugcuacccggacaccggaacagugaugugugugugcagagauaacuggcacggcucuaaucggcccugggucagcuucaaccagaaucuugacuaccagaucggguauauuugcuccggaguuuuuggcgauaacccucgccccaaggacggggaaggaagcuguaauccugugacgguggauggcgcugacggcgucaaaggguucucuuacaaguauggaaacggcguguggaucgggagaaccaaauccaaucggcugcgcaagggauuugagaugauuugggaccccaacggcuggacaaauaccgauagcgacuucucuguuaaacaagauguggucgccaucacagacugguccggguacagcggcuccuuugugcagcacccggaacucaccggacuggauugcaucagaccuuguuucuggguugagcuugugcggggccugccccgcgaaaacacgacaauuuggaccucugggagcuccaucucuuucugcggagucaacagcggcaccgcgaauugguccuggccugacggggccgagcuccccuuuacaauugauaaguga

SEQ ID NO: 204531 - RNA, 1413 nt, Artificial Sequence; identical to SEQ ID NO: 200485
  derived and/or modified sequence opt5 from neuraminidase__InfluenzaA__AEX34782

SEQ ID NO: 204532 - RNA, 1413 nt, Artificial Sequence
  derived and/or modified sequence opt5 from neuraminidase__InfluenzaA__AEX34793
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggucggcaauucuagccuuuguuccauuagcgggugggcgaucuacaccaaagauaacucuauucggaucggauccaagggcgacguguucguuauucgcgagccguuuaucagcugcucucaucuggaguguaaaacguucuuucucacccaaggcgcucugcuuaaugauaagcacuccaacgggacagugaaggacagaagccccuaucgggcccugaugucuugcccucucggagaagcccccuccccuuacaauagcaaauucgaguccgucgcuuggucugccagcgcuugucaugauggcaucggguggcugaccauuggaaucuccggccccgacaacggggccguggcgguucugaaguauaaaggaauuaucacaggcaccauuaagagcuggaaaaagcagauccuccgcacgcaggaaucugagugcguguguaugaacggcuccugcuuuacaaucaugaccgaugggccuagcaauggagccgcuucuuacaagauuuucaaaaucgagaagggcaaagucacaaagagcauggaacugaacgccccgaauuuucacuaugaggaauguuccugcuaccccgacaccgggaccgugaugugugugugcagagauaacuggcacggaucuaaucggccuugggucagcuucaaccagaaucuugacuaccaaauuggcuauaucugcuccgggguuuuuggagauaacccccgcccuaaagacagagagggcagcuguaaucccgugacaguggauggcgcuaacggggucaagggauucucuuacaaauauggcaaugggguguggauuggacggacgaaguccaaccgcaucagaaagggcuuugagaugauuugggacccgaauggguggaccaacacagacagcgauuucucuguuaaacaggacaucguggccaucaccgauugguccggcuacagcggauccuuuguccagcauccugaacugacaggccucgacugcauucggcccuguuucuggguggagcugguucgcgggcuuccuagagaaaauaccacgaucuggacaucuggaagcuccauuucuuucugcggcgugaacggggauaucgcgaacuggagcuggcccgacggagccgagcugcccuuuaccauugauaaguga

SEQ ID NO: 204533 - RNA, 1413 nt, Artificial Sequence; identical to SEQ ID NO: 204532
  derived and/or modified sequence opt5 from neuraminidase__InfluenzaA__AEX34804

SEQ ID NO: 204534 - RNA, 1413 nt, Artificial Sequence
  derived and/or modified sequence opt5 from neuraminidase__InfluenzaA__AEX34815
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacugaccggcaacagcucccuuuguagcauuucugggugggcgaucuacacgaaggauaauuccauucggaucggaagcaaaggcgacgucuucgugauucgcgagccuuuuaucucuugcucccaccuggaauguagaaccuucuuucucacacaaggcgcucugcuuaacgauaagcauagcaaugggaccguuaaagaccggucuccguaucgcgcccugauguccugcccccucggagaggccccuagccccuacaacuccaaguucgaaucuguggcuuggagcgccuccgcuugucacgauggcaugggguggcugacaaucggaauuagcggcccugacaacggggccgucgcggugcugaaguauaauggaaucauuaccggcacgaucaaaucuuggaagaaacagauucucagaacacaggaguccgagugcguuuguaugaacggcagcugcuuuaccaucaugacagaugggcccucuaauaaggccgcuagcuacaaaaucuucaagauugaaaagggaaaagugaccaaguccaucgagcugaacgccccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuacaguggauggcgcuaacggggugaaaggauucuccuauaaguacggcaauggggucuggaucggacggacgaaaagcaaccgccugagaaagggcuuugagaugauuugggaccccaauggguggaccaacacagacucugauuucuccgugaaacaggacguuguggccaucaccgauuggagcggcuauuccggaucuuuuguccagcacccggaacucacaggccuggacugcauccggccuuguuucuggguggagcuuguucgcgggcugcccagagaaaacaccacgauuuggacaagcggauccucuaucagcuucugcggcgucaauuccgauaccgcgaacuggagcuggccugacggggccgagcuccccuuuaccauugauaaguga

SEQ ID NO: 204535 - RNA, 1413 nt, Artificial Sequence; identical to SEQ ID NO: 204532
  derived and/or modified sequence opt5 from neuraminidase__InfluenzaA__AEX34826

SEQ ID NO: 204536 - RNA, 1413 nt, Artificial Sequence; identical to SEQ ID NO: 204532
  derived and/or modified sequence opt5 from neuraminidase__InfluenzaA__AEX34837

SEQ ID NO: 204537 - RNA, 1413 nt, Artificial Sequence
  derived and/or modified sequence opt5 from neuraminidase__InfluenzaA__AEX34859
augaaccccaaucagaagaucauuaccaucggcagcacauccauugccaucgggauuaucucucugaugcuccaaaucggaaacauuaucagcauuugggcuucccacucuauccagacgggcagccagaaucauaccgggauuugcaaccagagaaucauuacauacgaaaauuccaccugggugaaccacacauaugucaauaucaacaauaccaacguuguggccggaaaagacaagacaccugugacccugaucggcaauucuagccuuuguuccauuagcgggugggcgaucuacacgaaagauaacucuauucggaucggauccaagggcgacgucuucgugauucgcgagccguuuaucagcugcucucaucuggaguguaaaaccuucuuucucacacaaggcgcucugcuuaaugauaagcacuccaacgggaccguuaaggacagaagccccuaucgggcccugaugucuugcccucucggagaagcccccuccccuuacaauagcaaauucgaguccguggcuuggucugccagcgcuugucaugauggcaucggguggcugacaauuggaaucuccggccccgacaacggggccgucgcggugcugaaguauaaaggaauuaucaccggcacgauuaagagcuggaaaaagcagauccuccgcacacaggaaucugagugcguuuguaugaacggcuccugcuuuaccaucaugacagaugggccuagcaauggagccgcuucuuacaagauuuucaaaaucgagaagggcaaagugaccaagagcauggaacugaacgccccgaauuuucacuaugaggaauguuccugcuaccccgacaccgggacagucaugugugugugcagagauaacuggcacggaucuaaucggccuugggugagcuucaaccagaaucuugacuaccaaauuggcuauaucugcuccggggucuuuggagauaacccccgcccuaaagacagagagggcagcuguaaucccguuacgguggauggcgcuaacggggugaagggauucucuuacaaauauggcaauggggucuggauuggacggaccaaguccaaccgcaucagaaagggcuuugagaugauuugggacccgaauggguggacaaacaccgacagcgauuucucugugaaacaggacaucguugccaucacagauugguccggcuacagcggauccuuugugcagcauccugaacugaccggccucgacugcauucggcccuguuucugggucgagcuggugcgcgggcuuccuagagaaaauacgacaaucuggaccucuggaagcuccauuucuuucugcggcguuaacggggauaucgcgaacuggagcuggcccgacggagccgagcugcccuuuaccauugauaaguga

SEQ ID NO: 204538 - RNA, 1413 nt, Artificial Sequence
  derived and/or modified sequence opt5 from neuraminidase__InfluenzaA__AEX34870
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaauuucugugacccuggcgggcaacagcucccuuuguagcaucucugggugggcuauuuacacaaaggauaauuccauccggauuggaagcaaaggcgacgucuucgugauccgcgagccuuuuaucucuugcucccaccuggaauguagaaccuucuuucucacgcaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcauuggguggcugacaaucggaauuagcggcccugacaacggggcggucgccgugcugaaguauaauggaaucauuaccggcacaaucaaaucuuggaagaaacagauccucagaacccaggaguccgagugcguuuguaugaacggcagcugcuuuacgauuaugacagaugggcccucuaauaaggcugccagcuacaaaaucuucaagauugaaaagggaaaagugaccaaguccaucgagcugaacgcuccuaauuuuuauuacgaagaguguucuugcuacccggacacaggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggaccaaaagcaaccgccugagaaagggcuuugagaugaucugggaccccaauggguggacaaacacggacucugauuucuccgugaaacaggacguuguggcgauuaccgauuggagcggcuauuccggaucuuuuguccagcacccggaacucacaggccuggacugcauccggccuuguuucuggguggagcuuguucgcgggcugcccagagaaaacaccacaauuuggaccagcggauccucuaucagcuucugcggcgucaauuccgauacggccaacuggagcuggccugacggggcugagcuccccuuuacaauugauaaguga

SEQ ID NO: 204539 - RNA, 1413 nt, Artificial Sequence
  derived and/or modified sequence opt5 from neuraminidase__InfluenzaA__AEX34881
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaaggcgccugugacccugauuggcaauucuagccuuuguuccaucagcgggugggcuauuuacacaaaagauaacucuauccggauuggauccaagggcgacgucuucgugauccgcgagccguuuaucagcugcucucaucuggaguguaaaaccuucuuucucacgcaaggcgcccugcuuaaugauaagcacuccaacgggaccguuaaggacagaagccccuaucgggcccugaugucuugcccucucggagaagcucccuccccuuacaauagcaaauucgaguccguggccuggucugcuagcgccugucaugauggcauuggguggcugacaaucggaauuuccggccccgacaacggggcggucgccgugcugaaguauaaaggaaucauuaccggcacaaucaagagcuggaaaaagcagauccuccgcacccaggaaucugagugcguuuguaugaacggcuccugcuuuacgauuaugacagaugggccuagcaauggagcugccucuuacaagaucuucaaaauugagaagggcaaagugaccaagagcauggaacugaacgcuccgaauuuucacuaugaggaauguuccugcuaccccgacacagggaccgucaugugugugugcagagauaacuggcacggaucuaaucggccuugggugagcuucaaccagaaucuugacuaccaaaucggcuauauuugcuccggggucuuuggagauaacccccgcccuaaagacagagagggcagcuguaaucccguuaccguggauggcgccaacggggugaagggauucucuuacaaauauggcaauggggucuggaucggacggacaaaguccaaccgcauuagaaagggcuuugagaugaucugggacccgaauggguggacgaacaccgacagcgauuucucugugaaacaggacaucguugcgauuacagauugguccggcuacagcggauccuuugugcagcauccugaacugaccggccucgacugcauccggcccuguuucugggucgagcuggugcgcgggcuuccuagagaaaauacaaccauuuggacgucuggaagcuccaucucuuucugcggcguuaacggggauauugccaacuggagcuggcccgacggagcugagcugcccuuuacaaucgauaaguga

SEQ ID NO: 204540 - RNA, 1413 nt, Artificial Sequence
  derived and/or modified sequence opt5 from neuraminidase__InfluenzaA__AEX34892
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacagaacguuguggcgaucacagacuggagcggcuauuccggaucuuuuguccagcacccggaacucaccggccuggauugcauccggccuuguuucuggguggagcuuguucgcgggcugcccagagaaaauacaaccauuuggacgagcggauccucuaucagcuucugcggcgugaacuccgacacagccaauuggagcuggccugauggggcugagcuccccuuuaccauugacaaguga

SEQ ID NO: 204541 - RNA, 1413 nt, Artificial Sequence
  derived and/or modified sequence opt5 from neuraminidase__InfluenzaA__AEX34903
augaaccccaaucagaagaucauuaccaucggcagcauuuccaucgccauugggaucaucucucugaugcuccaaauuggaaacaucauuagcaucugggcuuccagaucuauucagacaggcagccagaaucacacggggaucugcaaccagcggauuaucaccuacgaaaauuccacaugggugaaccauaccuaugucaauaucaacaauacaaacguuguggccggaaaagacaagaccccugugacacuggucggcaauucuagccuuuguuccauuagcgggugggcgaucuacaccaaagauaacucuauucgcaucggauccaagggcgacguguucguuauuagagagccguuuaucagcugcucucaccuggaguguaaaacguucuuucucacccaaggcgcucugcuuaaugauaagcauuccaacgggacagugaaggaccggagccccuaucgcgcccugaugucuugcccucucggagaagcccccuccccuuacaauagcaaauucgaguccgucgcuuggucugccagcgcuugucacgauggcaucggguggcugaccauuggaaucuccggccccgacaacggggccguggcgguucugaaguauaaaggaauuaucacaggcaccauuaagagcuggaaaaagcagauccucagaacgcaggaaucugagugcguguguaugaacggcuccugcuuuacaaucaugaccgaugggccuagcaauggagccgcuucuuacaagauuuucaaaaucgagaagggcaaagucacaaagagcauggaacugaacgccccgaauuuucauuaugaggaauguuccugcuaccccgacaccgggaccgugaugugugugugccgggauaacuggcacggaucuaaucgcccuugggucagcuucaaccagaaucuugacuaccaaauuggcuauaucugcuccgggguuuuuggagauaaccccagaccuaaagaccgggagggcagcuguaaucccgugacaguggauggcgcuaacggggucaagggauucucuuacaaauauggcaaugggguguggauuggacgcacgaaguccaacagaauccggaagggcuuugagaugauuugggacccgaauggguggaccaacacagacagcgauuucucuguucgccaggacaucguggccaucaccgauugguccggcuacagcggauccuuuguccagcacccugaacugacaggccucgacugcauuagacccuguuucuggguggagcugguucgggggcuuccucgcgaaaauaccacgaucuggacaucuggaagcuccauuucuuucugcggcgugaacggggauaucgcgaacuggagcuggcccgacggagccgagcugcccuuuaccauugauaaauga

SEQ ID NO: 204542 - RNA, 1413 nt, Artificial Sequence; identical to SEQ ID NO: 200485
  derived and/or modified sequence opt5 from neuraminidase__InfluenzaA__AEX34914

SEQ ID NO: 204543 - RNA, 1413 nt, Artificial Sequence; identical to SEQ ID NO: 200485
  derived and/or modified sequence opt5 from neuraminidase__InfluenzaA__AEX34925

SEQ ID NO: 204544 - RNA, 1413 nt, Artificial Sequence; identical to SEQ ID NO: 200485
  derived and/or modified sequence opt5 from neuraminidase__InfluenzaA__AEX34936

SEQ ID NO: 204545 - RNA, 1413 nt, Artificial Sequence; identical to SEQ ID NO: 200485
  derived and/or modified sequence opt5 from neuraminidase__InfluenzaA__AEX34947

SEQ ID NO: 204546 - RNA, 1413 nt, Artificial Sequence; identical to SEQ ID NO: 200485
  derived and/or modified sequence opt5 from neuraminidase__InfluenzaA__AEX34958

SEQ ID NO: 204547 - RNA, 1413 nt, Artificial Sequence; identical to SEQ ID NO: 200485
  derived and/or modified sequence opt5 from neuraminidase__InfluenzaA__AEX34969

SEQ ID NO: 204548 - RNA, 1413 nt, Artificial Sequence; identical to SEQ ID NO: 200485
  derived and/or modified sequence opt5 from neuraminidase__InfluenzaA__AEX34980

SEQ ID NO: 204549 - RNA, 1413 nt, Artificial Sequence; identical to SEQ ID NO: 200485
  derived and/or modified sequence opt5 from neuraminidase__InfluenzaA__AEX34991

SEQ ID NO: 204550 - RNA, 1413 nt, Artificial Sequence
  derived and/or modified sequence opt5 from neuraminidase__InfluenzaA__AEX35002
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacugauuggcaauucuagccuuuguuccaucagcgggugggcgauuuacaccaaagauaacucuauccggauuggauccaagggcgacgucuucgugauccgcgagccguuuaucagcugcucucaucuggaguguaaaacguucuuucucacccaaggcgcucugcuuaaugauaagcacuccaacgggacaguuaaggacagaagccccuaucgggcccugaugucuugcccucucggagaagcccccuccccuuacaauagcaaauucgaguccguggcuuggucugccagcgcuugucaugauggcauuggguggcugaccaucggaauuuccggccccgacaacggggccgucgcggugcugaaguauaaaggaaucauuacaggcaccaucaagagcuggaaaaagcagauccuccgcacgcaggaaucugagugcguuuguaugaacggcuccugcuuuacaauuaugaccgaugggccuagcaauggagccgcuucuuacaagaucuucaaaauugagaagggcaaagugacaaagagcauggaacugaacgccccgaauuuucacuaugaggaauguuccugcuaccccgacaccgggaccgucaugugugugugcagagauaacuggcacggaucuaaucggccuugggugagcuucaaccagaaucuugacuaccaaaucggcuauauuugcuccggggucuuuggagauaacccccgcccuaaagacagagagggcagcuguaaucccguuacaguggauggcgcuaacggggugaagggauucucuuacaaauauggcaauggggucuggaucggacggacgaaguccaaccgcauuagaaagggcuuugagaugaucugggacccgaauggguggaccaacacagacagcgauuucucugugaaacaggacaucguugccauuaccgauugguccggcuacagcggauccuuugugcagcauccugaacugacaggccucgacugcauccggcccuguuucugggucgagcuggugcgcgggcuuccuagagaaaauaccacgauuuggacaucuggaagcuccaucucuuucugcggcguuaacggggauauugcgaacuggagcuggcccgacggagccgagcugcccuuuaccaucgauaaguga

SEQ ID NO: 204551 - RNA, 1413 nt, Artificial Sequence; identical to SEQ ID NO: 200485
  derived and/or modified sequence opt5 from neuraminidase__InfluenzaA__AEX35013

SEQ ID NO: 204552 - RNA, 1413 nt, Artificial Sequence; identical to SEQ ID NO: 200485
  derived and/or modified sequence opt5 from neuraminidase__InfluenzaA__AEX35024

SEQ ID NO: 204553 - RNA, 1413 nt, Artificial Sequence; identical to SEQ ID NO: 200485
  derived and/or modified sequence opt5 from neuraminidase__InfluenzaA__AEX35035

SEQ ID NO: 204554 - RNA, 1413 nt, Artificial Sequence; identical to SEQ ID NO: 200485
  derived and/or modified sequence opt5 from neuraminidase__InfluenzaA__AEX35046

SEQ ID NO: 204555 - RNA, 1413 nt, Artificial Sequence; identical to SEQ ID NO: 200485
  derived and/or modified sequence opt5 from neuraminidase__InfluenzaA__AEX35057

SEQ ID NO: 204556 - RNA, 1413 nt, Artificial Sequence; identical to SEQ ID NO: 200485
  derived and/or modified sequence opt5 from neuraminidase__InfluenzaA__AEX35068

SEQ ID NO: 204557 - RNA, 1413 nt, Artificial Sequence
  derived and/or modified sequence opt5 from neuraminidase__InfluenzaA__AEX35079
augaaccccaaucagaagaucauuaccaucggcagcauuuccaucgccauugggaucaucucucugaugcuccaaauuggaaacaucauuagcaugugggcuucccacucuauccagacaggcagccagaauaacacggggauuugcaaucagagaaucauuaccuacgagaacuccacaugggugaaucauaccuaugucaacaucaauaacacaaauguuguggccggagaagacaaaaccucugugacacuggcgggcaacagcucccuuuguagcaucucugggugggcuauuuacaccaaggauaauuccauccggauuggaagcaaaggcgacgucuucgugauccgcgagccuuuuauuucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaaucagcggcccugacaacggggcggucgccgugcugaaguauaauggaauuaucacaggcaccauuaaaucuuggaagaaacagauccucagaacgcaggaguccgagugcguuuguaugaacggcagcugcuuuacaauuaugaccgaugggcccucuaauaaggcugccagcuacaaaaucuucaagaucgaaaagggaaaagugacaaaguccauugagcugaacgcuccuaauuuuuauuacgaagaguguucuugcuacccggacaccggcaucgucaugugugugugccgggauaacuggcaugggagcaaucgccccuggguguccuucaaccaggaccuugauuaucaaauuggauacaucugcagcggcgucuuuggggacaauccuagacccgaggauggagaaggcucuuguaacccuguuaccguggacggcgccaauggggugaaaggauucuccuauaaguacggcaacggggucuggauuggacggacaaaaagcaaucgccugagaaagggcuuugagaugaucugggaccccaacggguggacgaauaccgauucugacuucuccgugaaacaggauguuguggcgauuacagacuggagcggcuauuccggaucuuuuguccagcacccggaacucaccggccuggauugcauccggccuuguuucuggguggagcuuguucgcgggcugcccagagaaaacacaaccaucuggacgagcggauccucuauuagcuucugcggcgugaacuccgacacagccaauuggagcuggccugauggggcugagcuccccuuuaccaucgacaaguga

SEQ ID NO: 204558 - RNA, 1413 nt, Artificial Sequence; identical to SEQ ID NO: 204532
  derived and/or modified sequence opt5 from neuraminidase__InfluenzaA__AEX35090

SEQ ID NO: 204559 - RNA, 1413 nt, Artificial Sequence
  derived and/or modified sequence opt5 from neuraminidase__InfluenzaA__AEX35101
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuaccguggauggcgccaacggggugaaaggauucuccuacaaguaugacaauggcgucuggaucgggcggacaaaaagcaaccgccugagaaagggauuugagaugauuugggaccccaauggcuggacgaacaccgauucuguguucuccguuaaacaggacguggucgcgaucacagauuggagcggguacuccggcucuuuugugcagcacccggaacucaccggacuggacugcauccggccuuguuucuggguugagcuugugcgcggccugcccagagaaaacacaaccauuuggacgagcggguccucuaucagcuucugcggagucaauuccgauacagccaacuggagcuggccugacggcgcugagcuccccuuuaccauugauaaguga

SEQ ID NO: 204560 - RNA, 1413 nt, Artificial Sequence
  derived and/or modified sequence opt5 from neuraminidase__InfluenzaA__AEX35112
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuucuaauuuuuauuacgaagaguguagcugcuacccugacaccggcauugucaugugugugugccgggauaacuggcauggguccaaucgcccgugggugagcuucaaccagaaucuugacuaucaaaucggauacauuugcucuggcgucuuuggggauaaccccagaccugaggacggagaaggcuccuguaaucccguuaccguggauggcgccaacggggugaaaggauucagcuauaaguacggcaauggggucuggaucggacggacaaaaucuaaccgccugagaaagggcuuugagaugauuugggacccuaauggguggacgaacaccgacuccgauuucagcgugaaacaggacguuguggcgaucacagauugguccggcuauucuggcagcuuuguccagcaccccgaacucaccggacuggacugcauccggccguguuucuggguggagcuuguucgcgggcugccuagagaaaacacaaccauuuggacguccggaucuagcaucuccuucugcggcgugaauagcgauacagccaacuggucuuggcccgacggggcugagcucccuuuuaccauugauaaguga

SEQ ID NO: 204561 - RNA, 1413 nt, Artificial Sequence; identical to SEQ ID NO: 200485
  derived and/or modified sequence opt5 from neuraminidase__InfluenzaA__AEX35123

SEQ ID NO: 204562 - RNA, 1413 nt, Artificial Sequence
  derived and/or modified sequence opt5 from neuraminidase__InfluenzaA__AEX35145
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacaucguugcgaucacagauuggagcggcuauuccggaucuuuugugcagcacccggaacucaccggccuggacugcauucggccuuguuucugggucgagcuugugcgcgggcugcccagagaaaacacaaccaucuggacgagcggauccucuauuagcuucugcggcguuaauuccgauacagccaacuggagcuggccugacggggcugagcuccccuuuaccaucgauaaguga

SEQ ID NO: 204563 - RNA, 1413 nt, Artificial Sequence; identical to SEQ ID NO: 204532
  derived and/or modified sequence opt5 from neuraminidase__InfluenzaA__AEX35156

SEQ ID NO: 204564 - RNA, 1413 nt, Artificial Sequence; identical to SEQ ID NO: 200485
  derived and/or modified sequence opt5 from neuraminidase__InfluenzaA__AEX35167

SEQ ID NO: 204565 - RNA, 1413 nt, Artificial Sequence
  derived and/or modified sequence opt5 from neuraminidase__InfluenzaA__AEX35178
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaagagcggauucucagaacgcaggaguccgaaugcguuugugugaauggcagcugcuuuacaaucaugaccgauggccccucuaacggggcugccagcuacaagaucuucaaaauugagaagggaaaggucacaaaaucccgcgaacugaaugcuccuaacuuucacuaugaggaguguucuugcuacccggacaccggcaccgugaugugugugugcagagauaauuggcacgggagcaaccggcccugggucuccuucaaucagaaccuugacuaccagaucggauauauuugcagcggcguuuuuggggauaauccucgccccaaggacggaaaaggcucuuguaacccugugacagccgauggcgcggacggggugaagggauucuccuacaaauauggcaauggggucuggaucggaagaacgaaguccaaccggcugcgcaaaggcuuugaaaugauuugggaccccaauggguggaccgauacagacucugauuucuccgugaagcaagacguuguggccaucaccgauuggagcggcuacuccggaucuuuuguccagcauccggagcucacaggccuggacugcauuagaccuuguuucuggguggaacuuguucgggggcugccccgcgagaacaccacgaucuggacaagcggauccucuaucagcuucugcggcguggauuccgacaccgcuaauuggagcuggccugauggggccgaacuccccuuuaccauugacaaguga

SEQ ID NO: 204566 - RNA, 1413 nt, Artificial Sequence; identical to SEQ ID NO: 204506
  derived and/or modified sequence opt5 from neuraminidase__InfluenzaA__AEX35189

SEQ ID NO: 204567 - RNA, 1413 nt, Artificial Sequence; identical to SEQ ID NO: 204506
  derived and/or modified sequence opt5 from neuraminidase__InfluenzaA__AEX35200

SEQ ID NO: 204568 - RNA, 1413 nt, Artificial Sequence; identical to SEQ ID NO: 200485
  derived and/or modified sequence opt5 from neuraminidase__InfluenzaA__AEX35211

SEQ ID NO: 204569 - RNA, 1410 nt, Artificial Sequence
  derived and/or modified sequence opt5 from neuraminidase__InfluenzaA__AEX35222
augaaccccaaucagaagaucauuaccaucggcagcgugucccugacaauuucuacgaucugcuucuuuaugcaaauugccauccucgucaccacaguuacccugcacuucaaacaguacgaguguaacagcccuccgaauaaccaggugaugcuuugcgaacccacaaucauugagagaaauaucaccgaaauuguguaucugacaaacaccacgaucgagaaggaaauuuguccuaaacucgcugaguaccggaauugguccaagccccagugcaacaucaccggguuugccccuuucucuaaagacaauagcauucgccuguccgcgggaggcgauaucugggucacaagagagcccuaugugucuugugacccugauaagugcuaccaauuugcucuugggcagggaaccacacugaacaauggccauagcaacgacaccguucacgaucggacgccguaucgcacacuccugaugaaugaacugggggugcccuuccaucucggaaccaagcaggucuguaucgccugguccucuagcuccugccacgacggcaaagccuggcugcauguguguguuacaggcgaugacgagaacgcuaccgccagcuuuauuuacaaugggagacuuguggauucuaucggauccuggagcaagaaaauucugcggacccaggaaucugagugcgucuguaucaacggcacaugcacgguggugaugaccgacggguccgcuagcggaaaggccgauacaaaaauucucuucaucgaggaaggcaagaucguccacaccuccacacugucugggagcgcgcaacacguugaggaaugcuccuguuauccucgcuaccccggagugagaugcgugugucgggacaacuggaagggcagcaaucgcccuauugucgauaucaacauuaaagacuacucuaucguguccagcuauguuugcucuggccuugugggggacacccccagaaagaaugauagcuccucuagcucccauugucuggacccgaacaaugaggaaggaggccacggggucaaaggaugggccuuugaugacggcaacgauguguggauggggcggacgauuagcgagaagcuccgcucuggauacgagacauucaaaguuaucgaaggcugguccaagccuaauagcaaacugcagaucaacagacaggugauugucgaccggggcaaucgcucuggguauuccggaaucuuuagcguggagggcaaguccugcauuaacagauguuucuacgucgaacugauccgggggagaaagcaggagaccgaagugcucuggaccucuaauagcauuguuguguuuugcggaacauccggcaccuaugggacaggcucuuggcccgauggagcugacaucaaccugaugccuauuuga

SEQ ID NO: 204570 - RNA, 1413 nt, Artificial Sequence; identical to SEQ ID NO: 204465
  derived and/or modified sequence opt5 from neuraminidase__InfluenzaA__AEX35233

SEQ ID NO: 204571 - RNA, 1410 nt, Artificial Sequence
  derived and/or modified sequence opt5 from neuraminidase__InfluenzaA__AEX35244
augaaccccaaucagaagaucauuaccaucggcagcgugucccugacaauuucuacgaucugcuucuuuaugcaaauugccauccucaucaacaccgucacacugcacuucaaacaguacgaguuuaauagcccuccgaacaaucagguuaugcuuugugaacccaccauuaucgagagaaacauuacagaaaucguguaucugaccaauacaaccauugagaaggaaaucugcccuaaacucgcugaguaccggaacugguccaagccccaguguaauauuacgggguucgccccuuuuucuaaagacaacagcauccgccuguccgcgggaggcgauaucugggugaccagagagcccuaugucucuugcgacccugauaaguguuaccaauucgcucuugggcagggaacaacccugaauaacgugcauagcaaugacacaguucacgaucggaccccguaucgcacgcuccugaugaacgaacugggcgugcccuuucaucucgggacaaagcaggucugcauugccugguccucuagcuccugucacgacggaaaagccuggcugcaugugugcguuaccggcgaugacaagaaugcuacagccagcuucaucuacaacggcagacuuguggauucuauugucuccuggagcaaaaagauccugcggacccaggagucugaaugugugugcauuaacgggaccuguacaguggucaugacggacggauccgcuagcggcaaagccgauaccaagauccucuuuaucgaggaggggaagauuguucacacauccacccugucuggaagcgcgcaacacguggaagagugcuccugcuauccucgcuaccccggcgugagaugugucugccgggacaauuggaaagggagcaaccgcccuaucguggauauuaauaucaaggacuacucuauuguuuccagcuauguguguucuggacuugucggcgacacaccccggaaaaacgauagcuccucuagcucccauugccuggacccgaauaacgaagagggcgggaauggagugaagggcugggccuucgaugacgggaacgauguuuggaugggaagaaccaucagcgaaaaacuccgcucuggcuacgagacguuuaaggugaucgaggggugguccaauccuaacagcaaacugcagauuaauagacaggucaucguggaccggggaaaccgcucuggcuauuccggcauuuucagcgucgaagggaaguccuguaucaauagaugcuuuuacguggagcugauucggggaagaaagcaggaaaacgagguucucuggacaucuaauagcaucguggucuucuguggcaccuccgggaccuauggaacaggcucuuggcccgauggggcugacauuaaccugaugccuguguga

SEQ ID NO: 204572 - RNA, 1410 nt, Artificial Sequence; identical to SEQ ID NO: 198953
  derived and/or modified sequence opt5 from neuraminidase__InfluenzaA__AEX35255

SEQ ID NO: 204573 - RNA, 1413 nt, Artificial Sequence; identical to SEQ ID NO: 204465
  derived and/or modified sequence opt5 from neuraminidase__InfluenzaA__AEX35266

SEQ ID NO: 204574 - RNA, 1413 nt, Artificial Sequence; identical to SEQ ID NO: 204465
  derived and/or modified sequence opt5 from neuraminidase__InfluenzaA__AEX35277

SEQ ID NO: 204575 - RNA, 1410 nt, Artificial Sequence
  derived and/or modified sequence opt5 from neuraminidase__InfluenzaA__AEX35288
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacaaccggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaaaagauccugcggacccaggagucugaaugugugugcauuaacgggacauguacgguggucaugaccgacggauccgcuagcggcaaagccgauacaaagauccucuuuaucgaggaggggaagauuguucacaccuccacacugucuggaagcgcgcaacacguggaagagugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcucccauugccuggacccgaacaaugaagagggcgggcacggagugaaaggcugggccuucgaugacgggaacgauguuuggaugggacggacgaucagcgaaaaacuccgcucuggcuacgagacauuuaaggugaucgaggggugguccaauccuaacagcaaacugcagauuaauagacaggucaucguggaccggggaaaccgcucuggcuauuccggcauuuucagcgucgaagggaaguccuguaucaauagaugcuuuuacguggagcugauucggggaagaaaggaagagaccgaaguucucuggaccucuaacagcaucguggucuucuguggcacauccgggaccuauggaacaggcucuuggcccgauggggcugacauuaaucugaugccuaucuga

SEQ ID NO: 204576 - RNA, 1410 nt, Artificial Sequence; identical to SEQ ID NO: 197738
  derived and/or modified sequence opt5 from neuraminidase__InfluenzaA__AEX35299

SEQ ID NO: 204577 - RNA, 1410 nt, Artificial Sequence
  derived and/or modified sequence opt5 from neuraminidase__InfluenzaA__AEX35310
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacggggaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaucaggagaccgaaguucucuggaccucuaacagcaucguggucuucuguggcacauccgggaccuauggaacaggcucuuggcccgacggggcugauauuaaucugaugccuaucuga

SEQ ID NO: 204578 - RNA, 1410 nt, Artificial Sequence; identical to SEQ ID NO: 197738
  derived and/or modified sequence opt5 from neuraminidase__InfluenzaA__AEX35321

SEQ ID NO: 204579 - RNA, 1410 nt, Artificial Sequence; identical to SEQ ID NO: 198953
  derived and/or modified sequence opt5 from neuraminidase__InfluenzaA__AEX35332

SEQ ID NO: 204580 - RNA, 1410 nt, Artificial Sequence; identical to SEQ ID NO: 198953
  derived and/or modified sequence opt5 from neuraminidase__InfluenzaA__AEX35343

SEQ ID NO: 204581 - RNA, 1410 nt, Artificial Sequence
  derived and/or modified sequence opt5 from neuraminidase__InfluenzaA__AEX35354
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccacaagcggcaaagcugacaccaagauccucuuuaucgaggaggggaagauuguucacacauccacccugucuggaagcgcccaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacgccccggaaaaacgacagcuccucuagcucccauugccuggauccgaauaacgaagagggcgggcacggagugaagggcugggcguucgacgaugggaaugacguuuggaugggaagaacaaucagcgaaaaacuccgcucuggcuacgagaccuuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagaccgaaguucucuggacaucuaauagcaucguggucuucuguggcaccuccgggacauauggaacgggcucuuggcccgacggggccgauauuaaccugaugccuaucuga

SEQ ID NO: 204582 - RNA, 1410 nt, Artificial Sequence; identical to SEQ ID NO: 197738
  derived and/or modified sequence opt5 from neuraminidase__InfluenzaA__AEX35365

SEQ ID NO: 204583 - RNA, 1410 nt, Artificial Sequence
  derived and/or modified sequence opt5 from neuraminidase__InfluenzaA__AEX35376
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaacggacgccguaucgcacacuccugaugaacgagcugggcgugcccuuucaucucgggaccaagcaggucugcauugccugguccucuagcuccugucacgacggaaaagccuggcugcaugugugcguuacaggcgaugacaagaaugcuaccgccagcuucaucuacaacggcagacuuguggauucuauugucuccuggagcaaaaagauccugcggacccaggaaucugagugugugugcauuaaugggacauguacgguggucaugaccgacggauccgcuagcggcaaagccgauacaaagauccucuuuaucgaggaagggaagauuguucacaccuccacacugucuggaagcgcgcaacacguggaggaaugcuccugcuauccucgcuaccccggcgugagaugugucugccgggacaacuggaaagggagcaaccgcccuaucguggauauuaauaucaaggacuacucuauuguuuccagcuauguguguucuggacuugucggcgacacccccagaaagaacgauagcuccucuagcucccauugccuggacccgaauaacgaggaaggcgggcacggagugaaaggcugggccuucgaugacgggaaugauguuuggaugggacggacgaucagcgagaaacuccgcucuggcuacgagacauuuaaggugaucgaagggugguccaacccuaauagcaaacugcagauuaacagacaggucaucguggaccggggaaaucgcucuggcuauuccggcauuuucagcgucgaggggaaguccuguaucaacagaugcuuuuacguggaacugauucggggaagaaaggaggaaaccgagguucucuggaccucuaauagcaucguggucuucuguggcacauccgggaccuauggaacaggcucuuggcccgauggggcugacauuaaccugaugccuaucuga

SEQ ID NO: 204584 - RNA, 1410 nt, Artificial Sequence; identical to SEQ ID NO: 197738
  derived and/or modified sequence opt5 from neuraminidase__InfluenzaA__AEX35387

SEQ ID NO: 204585 - RNA, 1410 nt, Artificial Sequence
  derived and/or modified sequence opt5 from neuraminidase__InfluenzaA__AEX35398
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacaugugcuguggucaugacggauggauccgccagcggcaaagcggacaccaagauccucuuuaucgaggaggggaagauuguucacacauccacccugucuggaagcgcccaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacaccccggaaaaacgacagcuccucuagcucccauugccuggauccgaauaacgaagagggcgggcacggagugaagggcugggcuuucgacgaugggaaugacguuuggaugggaagaaccaucagcgaaaaacuccgcucuggcuacgagacguuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagacagaaguucucuggaccucuaauagcaucguggucuucuguggcaccuccgggacauauggaaccggcucuuggcccgacggggccgauauuaaccugaugccuaucuga

SEQ ID NO: 204586 - RNA, 1410 nt, Artificial Sequence; identical to SEQ ID NO: 197738
  derived and/or modified sequence opt5 from neuraminidase__InfluenzaA__AEX35409

SEQ ID NO: 204587 - RNA, 1410 nt, Artificial Sequence; identical to SEQ ID NO: 204575
  derived and/or modified sequence opt5 from neuraminidase__InfluenzaA__AEX35420

SEQ ID NO: 204588 - RNA, 1410 nt, Artificial Sequence
  derived and/or modified sequence opt5 from neuraminidase__InfluenzaA__AEX35431
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaagaaggagaccgaaguucucuggaccucuaacagcaucguggucuucuguggcacauccgggaccuauggaacaggcucuuggcccgauggggcugacauuaaucugaugccuaucuga

SEQ ID NO: 204589 - RNA, 1410 nt, Artificial Sequence; identical to SEQ ID NO: 197736
  derived and/or modified sequence opt5 from neuraminidase__InfluenzaA__AEX35453

SEQ ID NO: 204590 - RNA, 1410 nt, Artificial Sequence; identical to SEQ ID NO: 197736
  derived and/or modified sequence opt5 from neuraminidase__InfluenzaA__AEX35464

SEQ ID NO: 204591 - RNA, 1410 nt, Artificial Sequence; identical to SEQ ID NO: 197736
  derived and/or modified sequence opt5 from neuraminidase__InfluenzaA__AEX35475

SEQ ID NO: 204592 - RNA, 1410 nt, Artificial Sequence; identical to SEQ ID NO: 197736
  derived and/or modified sequence opt5 from neuraminidase__InfluenzaA__AEX35486

SEQ ID NO: 204593 - RNA, 1410 nt, Artificial Sequence
  derived and/or modified sequence opt5 from neuraminidase__InfluenzaA__AEX35497
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaaaugcccuaagcucgcugaguaccggaauugguccaaaccccaguguaacaucaccggguucgccccuuuuucuaaggacaauagcauucgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaaacaggucugcaucgccugguccucuagcuccugucacgacggaaaggccuggcugcaugugugcguuacaggcgaugacaaaaacgcuaccgccagcuucauuuacaauggcagacuuguggauucuaucgucuccuggagcaaggagauucugcggacccaggaaucugagugugugugcaucaacgggacauguacgguggucaugaccgacggauccgcuagcggcaaagccgauacaaagauucucuuuaucgaggaagggaagaucguucacaccuccacacugucuggaagcgcgcaacacguggaggaaugcuccugcuauccucgcuaccccggcgugagaugugucugccgggacaacuggaaagggagcaaucgcccuauuguggauaucaacauuaaggacuacucuaucguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgauuagcgagaaacuccgcucuggcuacgagacauuuaaggugaucgaagggugguccaauccuaacagcaaacugcagaucaauagacaggucauuguggaccggggaaaccgcucuggcuauuccggcaucuucagcgucgaggggaaguccuguauuaauagaugcuuuuacguggaacugauccggggaagaaaggaggaaaccgagguucucuggaccucuaacagcauuguggucuucuguggcacauccgggaccuauggaacaggcucuuggcccgauggggcugacaucaaucugaugccuauuuga

SEQ ID NO: 204594 - RNA, 1410 nt, Artificial Sequence; identical to SEQ ID NO: 197736
  derived and/or modified sequence opt5 from neuraminidase__InfluenzaA__AEX35508

SEQ ID NO: 204595 - RNA, 1410 nt, Artificial Sequence; identical to SEQ ID NO: 204593
  derived and/or modified sequence opt5 from neuraminidase__InfluenzaA__AEX35519

SEQ ID NO: 204596 - RNA, 1410 nt, Artificial Sequence
  derived and/or modified sequence opt5 from neuraminidase__InfluenzaA__AEX35530
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcagugugaacccacaauuaucgagagaaauauuaccgaaaucguguaucuuacaaacaccacgauugagaaggaaaucugcccuaaacuggcugaguaccggaauugguccaagccccaaugugacauuaccggguucgccccuuuuucuaaagauaacagcauccgccucuccgcgggaggcgacaucugggugacaagagagcccuaugucucuugcgauccugacaaguguuaccaguucgcucuggggcagggaaccacacuuaauaacgugcauagcaaugauaccguucacgaccggacgccguaucgcacacugcucaugaacgaacugggcgugcccuuucaucuggggaccaagcaggucugcauugccugguccucuagcuccugucacgauggaaaagccuggcuccaugugugcguuacaggcgacgauaagaaugcuaccgccagcuucaucuacaacggcagacugguggacucuauugucuccuggagcaaagagauccuucggacccaagaaucugagugugugugcauuaaugggacauguacgguggucaugaccgauggauccgcuagcggcaaggccgacacaaaaauccuguuuaucgaggaagggaagauuguucacaccuccacacucucuggaagcgcgcagcacguggaggaaugcuccugcuauccucgcuaccccggcgugagaugugucugccgggauaacuggaaggggagcaaccgcccuaucguggacauuaauaccaaagacuacucuaucguuuccagcuauguguguucuggacuggucggcgauacgcccagaaagaacgacagcuccucuagcucccauugccuuaauccgaacaaugaggaaggcgggcacggagugaaaggcugggccuucgaugacgggaacgauguuuggaugggacggacaauuagcgagaagcugcgccucggcuacgagaccuuuaaagugaucgaaggguggucuaauccuaacuccaagcugcagaucaauagacaggucauuguggaccggggaaaccgcagcggcuauucuggcaucuucuccgucgaggggaaaagcuguauuaauagaugcuuuuacguggaacugauccggggaagaaaggaggaaaccgagguucucuggacauccaacucuauuguggucuucuguggcaccagcgggacauauggaacgggcuccuggcccgauggggcugacaucaaucugaugccuauuuga

SEQ ID NO: 204597 - RNA, 1410 nt, Artificial Sequence; identical to SEQ ID NO: 197736
  derived and/or modified sequence opt5 from neuraminidase__InfluenzaA__AEX35541

SEQ ID NO: 204598 - RNA, 1410 nt, Artificial Sequence
  derived and/or modified sequence opt5 from neuraminidase__InfluenzaA__AEX35552
augaaccccaaucagaagaucauuaccaucggcagcgccucccugacaauuucuacgaucugcuucuuuaugcaaauugcuauccucaucaccacagugacccugcacuucaaacaguacgaguuuaacccuccgcccaauaaccaggccaugcuuugugaaccuacaauuaucgagagaaauauuaccgaaaucgucuaucugacaaacaccacgauugagaaggaaaucugccccaaacucgcggaguaccggaauuggagcaagccucagugugacauuaccggguucgcucccuuuuccaaagauaacucuauccgccugagcgccggaggcgacaucuggguuacaagagagccuuauguguccugcgauccggacaaguguuaccaauucgcccuugggcagggaaccacacugaauaacgugcauucuaaugauaccguccacgaccggacgcccuaucgcacacuccugaugaacgaacugggcgugccuuuucaucucgggaccaagcagguuugcauugcuuggagcuccagcucuugucacgauggaaaagccuggcugcaugugugcgucacaggcgacgauaagaaugcuaccgccuccuucaucuacaacggcagacuuguggacagcauuguuucuugguccaaagagauccugcggacccaggaaagcgagugugugugcauuaaugggacauguacggucgugaugaccgauggaucugcguccggcaaggccgacacaaaaauccucuuuaucgaggaagggaagauugugcacaccagcacacuguccggaucugcucaacacgucgaggaaugcagcugcuauccccgcuacccuggcguuagaugugugugccgggauaacuggaagggguccaaccgccccaucguggacauuaauaucaaagacuacagcauugccucuuccuaugucuguagcggacuugugggcgauaccccgagaaagaacgacucuagcuccucuagccauugccuggauccuaauaacgaggaaggcgggcacggaguuaaaggcugggcuuucgacgaugggaaugacguguggaugggacggacgaucuccgagaagcuccgcagcggcuacgagacauuuaaagucaucgaaggguggucuaaccccaauuccaagcugcagauuaacagacaggugaucguugaucggggaaaucgcagcggcuauucuggcauuuucuccguggaggggaaaagcuguaucaacagaugcuuuuacgucgaacugauucggggaagaaaggaggaaaccgaggugcucuggaccuccaauucuaucgucguguucuguggcacaagcgggaccuauggaacaggcuccuggccugacggggccgauauuaaccugaugcccaucuga

SEQ ID NO: 204599 - RNA, 1410 nt, Artificial Sequence
  derived and/or modified sequence opt5 from neuraminidase__InfluenzaA__AEX35563
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccugaauccgaacaaugaggaaggcgggcacggagugaaaggcugggccuucgaugacgggaacgauguuuggaugggacggacgaucagcgagaagcuccgccugggcuacgagacauuuaaagugaucgaaggguggucuaauccuaacuccaagcugcagauuaauagacaggucaucguggaccggggaaaccgcagcggcuauucuggcauuuucuccgucgaggggaaaagcuguaucaauagaugcuuuuacguggaacucauucggggaagaaaggaggaaaccgagguucuguggaccuccaacucuaucguggucuucuguggcacaagcgggaccuauggaacaggcuccuggcccgauggggcugacauuaaucuuaugccuaucuga

SEQ ID NO: 204600 - RNA, 1410 nt, Artificial Sequence; identical to SEQ ID NO: 204480
  derived and/or modified sequence opt5 from neuraminidase__InfluenzaA__AEX35585

SEQ ID NO: 204601 - RNA, 1410 nt, Artificial Sequence
  derived and/or modified sequence opt5 from neuraminidase__InfluenzaA__AEX35596
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccugacagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauauuaaccugaugccuaucuga

SEQ ID NO: 204602 - RNA, 1410 nt, Artificial Sequence; identical to SEQ ID NO: 197736
  derived and/or modified sequence opt5 from neuraminidase__InfluenzaA__AEX35607

SEQ ID NO: 204603 - RNA, 1410 nt, Artificial Sequence
  derived and/or modified sequence opt5 from neuraminidase__InfluenzaA__AEX35618
augaaccccaaucagaagaucauuaccaucggcagcgugucccugacaauuucuacgaucugcuucuuuaugcaaauugccauccucaucaccacagucacccugcacuucaaacaguacgagcuuaacagcccuccgaauaaccagguuaugcugugugaacccacaauuaucgagagaaauauuaccgaaaucguguaucucacaaacaccacgauugagaaggaaaccugcccuaaacuggcugaguaccggaauugguccaagccccaguguuauaucacaggguuugccccuuucucuaaagacaacagcauucgccuuuccgcgggaggcgauaucugggugaccagagagcccuacgucucuugcgacccugauaaguguuaucaauuugcucuggggcagggaacaacccucaauaacgugcauagcaaugacacgguucgggaucgcacaccguacagaacccugcugaugaacgaacucggcgugcccuuccaccuggggacaaagcaggucugcaucgccugguccucuagcuccugucaugacggaaaagccuggcuucacgugugcauuaccggcgaugacaagaaugcuaccgccagcuuuaucuauaacggccggcugguugauucuauuguguccuggagcaaagagauccuccgcacacaggaaucugagugugucugcauuaaugggacguguaccguggugaugacagacggauccgcuagcggcaaggccgauaccaaaauccuguucaucgaggaagggaagauuguccauacauccacccuuucuggaagcgcgcaacacguugaggaaugcuccugcuacccuagauaccccggcgugcggugugugugccgcgacaacuggaaggggagcaacagaccuaucgucgauauuaauaucaaagaccacucuauuguguccagcuauguuuguucuggacuggugggcgacacgccccggaagaacgauagcuccucuagcucccauugccucgacccgaauaacgaggaaggcgggcacggagucaaaggcugggccuuugaugacgggaaugauguguggaugggacgcacaaucagcgagaagucuagacugggcuacgagaccuucaaaguuaucgaagggugguccaacccuaagagcaaacugcagauuaaucgccaggugaucgucgaccgggauaacagaucuggauauuccggcauuuuuagcguggagggcaaguccuguaucaaucggugcuucuacgucgaacucauuagagggcgcaaggaggaaaccgaggugcuguggacaucuaacagcaucguuguguuuuguggaaccuccggcacauaugggacgggaucuuggcccgacggcgcugauauuaaucuuaugccuaucuga

SEQ ID NO: 204604 - RNA, 1410 nt, Artificial Sequence
  derived and/or modified sequence opt5 from neuraminidase__InfluenzaA__AEX35640
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccagcagcuccugucaugacggaaaggccuggcugcacgugugcguuacaggcgauaauaaaaacgcuaccgccagcuucaucuacaauggccggcuuguggacucuauugucuccuggagcaaggagauccugcgcacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccuagauaccccggcgugcggugugucugccgcgauaacuggagagggagcaaucggccuaucguggacauuaacaugaaagauuacucuaucguuuccagcuauguguguucuggacuugucggcgacacgccccgcaagaaugacagcuccucuagcggccacugccuggauccgaacgacgaggaagggggacauggcgugaaagggugggccuucgaugacggaaaugauguuuggaugggcagaaccauuuccgagaagucucggucuggguacgagacauuuaaagugaucgaaggaugguccaacccuaauagcaagcuccagaucaaccgccaggucauuguggacagaggcaaucggucuggcuauuccgggaucuucagcgucgagggaaaauccuguauuaacagaugcuuuuacguggaacugauccgcggccggaaggaggaaaccgagguucuguggaccucuaauagcauuguggucuucugugggacauccggaaccuauggcacagggucuuggcccgauggcgcugacaucaaccucaugccuauuuga

SEQ ID NO: 204605 - RNA, 1410 nt, Artificial Sequence
  derived and/or modified sequence opt5 from neuraminidase__InfluenzaA__AEX35651
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgaggacaaguccuguaucaaucggugcuuuuauguggaacugauuagagggcgcaaggaggaaaccgagguucucuggaccucuaacagcaucguggucuucuguggaacauccggcaccuacgggacaggaucuuggcccgauggcgcugacauuaaucugaugccuaucuga

SEQ ID NO: 204606 - RNA, 1410 nt, Artificial Sequence; identical to SEQ ID NO: 198908
  derived and/or modified sequence opt5 from neuraminidase__InfluenzaA__AEX36105

SEQ ID NO: 204607 - RNA, 1410 nt, Artificial Sequence
  derived and/or modified sequence opt5 from neuraminidase__InfluenzaA__AEX36116
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggaaccgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcgaggccgauacaaagauccucuuuauugaagaggggaaaaucguccauaccuccacacugucuggaagcgcgcaacacguugaagagugcuccugcuauccuagauaccccggcgugcggugugugugccgcgacaacuggaaggggagcaauagaccuauugucgauaucaacauuaaggaccacucuaucguguccagcuacguuuguucuggacuugugggcgacacgccccggaaaaaugauagcuccucuagcucccauugccuggacccgaacaaugaagagggcgggcacggagucaagggcugggccuucgaugacgggaacgauguguggaugggacgcaccaucagcgagaaaucuagacucggcuaugaaacauuuaagguuauugaggggugguccaauccuaaaagcaagcugcagaucaaccgccaggugauugucgaccggggaaauagaucuggcuacuccggcaucuucagcguggaagggaaauccuguauuaaccggugcuuuuaugucgagcugaucagaggacgcaaggaagagaccgaggugcucuggaccucuaauagcauuguuguguucuguggcacauccgggaccuacggaacaggcucuuggcccgauggggcugacaucaaccugaugccuaucuga

SEQ ID NO: 204608 - RNA, 1410 nt, Artificial Sequence
  derived and/or modified sequence opt5 from neuraminidase__InfluenzaA__AEX36127
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauuggcugaagccccagugugacauuaccggguucgccccuuuuuccaaagauaacucuauccgccuuagcgcgggaggcgacaucugggugacaagagagcccuaugucuccugcgauccugacaaguguuaccaauucgcucuggggcagggaaccacacucaauaacgugcauucuaaugauaccguucgggaccgcacgccguauagaacacugcugaugaacgaacucggcgugcccuuucaccuggggaccaagcaggucugcauugccuggagcuccagcucuugucaugauggaaaagccuggcuucacgugugcaucacaggcgacgauaagaaugcuaccgccuccuucauuuacaacggccggcugguugacagcguggucucuugguccaaagagauccuccgcacccaggaaagcgagugugugugcauuaaugggacauguacgguggucaugaccgauggaucugcuuccggcaaggccgacacaaaaauccuguuuaucgaggaagggaagauuguucauaccagcacacuuuccggaucugcgcaacacguggaggaaugcagcugcuauccuagauaccccggcgugcggugugucugccgcgauaacuggaagggguccaacagaccuaucguggacauuaauaucaaagaccacagcauuguuucuuccuacguguguagcggacuggucggcgauacgccccggaagaacgacucuagcuccucuagccauugccucgauccgaauaacgaggaaggcgggcacggagugaaaggcugggccuucgacgauggggacgauguuuggaugggacgcaccaucuccgaaaagagcagacugggcuaugagacauuuaaagugaucgagggguggucuaauccuaaguccaaacugcagauuaaccggcaggucaucguggaccgcggaaauagaagcggcuacucuggcauuuucuccgucgagggaaagagcuguaucaaccggugcuuuuauguggaacucauuagagggcgcaaggaggaaaccgagguucuguggaccuccaauucuaucguggucuucuguggcacaagcgggaccuacggaacaggcuccuggcccgauggggcugacauuaaccuuaugccuaucuga

SEQ ID NO: 204609 - RNA, 1410 nt, Artificial Sequence
  derived and/or modified sequence opt5 from neuraminidase__InfluenzaA__AEX36149
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgaggacaaguccuguaucaaucggugcuuuuauguggaacugauuagagggcgcaaggaggaaaccgagguucucuggaccacaaacucuaucguggucuucuguggaaccagcggcacauacgggacgggauccuggcccgauggcgcugacauuaaucugaugccuaucuga

SEQ ID NO: 204610 - RNA, 1410 nt, Artificial Sequence; identical to SEQ ID NO: 199536
  derived and/or modified sequence opt5 from neuraminidase__InfluenzaA__AEX36160

SEQ ID NO: 204611 - RNA, 1410 nt, Artificial Sequence
  derived and/or modified sequence opt5 from neuraminidase__InfluenzaA__AEX36171
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacaaucggacgccguaucgcacacuccugaugaacgaacugggcgugcccuuucaucucgggaccaagcaggucugcauugccuggucuagcuccagcugucacgacggaaaagccuggcugcaugugugcguuacaggcgaugacaagaaugcuaccgccucuuucaucuacaacggcagacuuguggauuccauugucagcuggucuaaagagauccugcggacccaggaauccgagugugugugcauuaaugggacaugugcuguggucaugacggacggaagcgccuccggcaaggcggauaccaaaauccucuuuaucgaggaagggaagauuguucacacaucuacccugagcggauccgcccaacacguggaggaaugcagcugcuauccucgcuaccccggcgugagaugugucugccgggacaacuggaaggggucuaaccgcccuaucguggauauuaauaucaaagacuacuccauuguuagcagauauguguguucuggacuugucggcgacacaccccggaagaacgauagcuccucuagcucccauugccuggacccgaauaacgaggaaggcgggcacggagugaaaggcugggcuuucgaugacggggaugacguuuggaugggacgcaccaucagcgagaagucuagauccggcuacgagacguuuaaagugaucgaaggguggagcaauccuaacucuaagcuccagauuaaucggcaggucaucguggaucgcggaaacagauccggcuauagcggcauuuucuccgucgaggggaaaucuuguaucaaucggugcuuuuacguggaacugauuagaggacgcaaggaggaaacagagguucuguggaccagcaacuccaucguggucuucuguggcaccucugggacauauggaaccggcagcuggcccgacggggccgauauuaaucucaugccuaucuga

SEQ ID NO: 204612 - RNA, 1410 nt, Artificial Sequence
  derived and/or modified sequence opt5 from neuraminidase__InfluenzaA__AEX36193
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggcaugcuuguugauuccaucgugagcuggucuaaagagauucugcggacccaggaauccgagugugucugcaucaacgggacauguacgguggugaugaccgacggaagcgcuuccggcaaggccgauacaaaaauccucuuuauugaggaagggaagaucguccauaccucuacacugagcggauccgcgcaacacguugaggaaugcagcugcuauccccgcuacccuggcgugagaugugugugccgggacaacuggaaggggucuaaucgccccauugucgauaucaacauuaaagaccacuccaucgugagcucuuacguuuguagcggacuugugggcgacaccccuagaaagaaugauuccucuagcuccagccauugccuggaccccaacaaugaggaaggcgggcacggagucaaaggcugggccuucgaugacgggaacgauguguggaugggacggacgaucucugagaagucccgccucggcuaugagacauuuaaaguuauugaaggguggagcaauccgaagucuaaacugcagaucaacagacaggugauugucgaccggggaaaucgcuccggcuacagcggcaucuucuccguggaggggaagucuuguauuaacagaugcuuuuaugucgaacugauccggggaagaaaggaggaaaccgaggugcucuggaccagcaauuccauuguuguguucuguggcacaucugggaccuacggaacaggcagcuggccugauggggcugacaucaaccugaugcccaucuga

SEQ ID NO: 204613 - RNA, 1410 nt, Artificial Sequence
  derived and/or modified sequence opt5 from neuraminidase__InfluenzaA__AEX36204
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccgcuauuaucgagagaaauauuacagaaaucguguaucugaccaacacaaccauugagaaggaaaucugcccuaaacucgccgaguaccggaauugguccaagccccagugugacauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaaugauacaguucacgaacggaccccguaucgcacgcuccugaugaacgagcugggcgugcccuuucaucucgggacaaagcaggucugcauugccugguccucuagcuccugucacgacggaaaggcuuggcugcaugugugcguuaccggcgaugacaagaaugccacagcuagcuucaucuacaacggcagacuuguggauucuauugucuccuggagcaaagaaauccugcggacccaggagucugagugugugugcauuaaugggaccuguacaguggucaugacggacggauccgccagcggcaaggcggauaccaaaauccucuuuaucgaagaggggaagauuguucacacauccacccugucuggaagcgcccaacacguggaagagugcuccugcuauccucgcuaccccggcgugagaugugucugccgggacaacuggaaggggagcaaccgcccuaucguggauauuaauaucaaagacuacucuauuguuuccagauauguguguagcggacuugucggcgacacaccccggaagaacgauucuagcuccucuagccauugccuggacccgaauaacgaagagggcgggcacggagugaaaggcugggcuuucgaugacgggaaugauguuuggaugggacgcaccaucuccgagaaaagcagaucuggcuacgaaacguuuaaagugaucgaggggugguccaacccuaauagcaagcuccagauuaaccggcaggucaucguggaccgcggaaauagaucuggcuauuccggcauuuucagcgucgaagggaaauccuguaucaaccggugcuuuuacguggagcugauuagaggacgcaaggaagagacagagguucuguggaccucuaauagcaucguggucuucuguggcaccuccgggacauauggaaccggcucuuggcccgauggggccgacauuaaccucaugccuaucuga

SEQ ID NO: 204614 - RNA, 1410 nt, Artificial Sequence
  derived and/or modified sequence opt5 from neuraminidase__InfluenzaA__AEX36215
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagaagaacauuacagaaaucguguaucugaccaauacaaccauugagaaagaaaucugcccuaagcucgccgaguacagaaacuggucuaaaccccagugugacauuacgggguucgcgccuuuuagcaaggauaauuccauccggcugucugcuggaggcgacaucugggugacccgcgagcccuaugucagcugcgauccugacaaguguuaccaauucgcccuugggcagggaacaacccugaacaaugugcauuccaacgauacaguucacgaaagaaccccguaucggacgcuccugaugaaugagcugggcgugcccuuucaucucgggacaaaacaggucugcauugccuggucuagcuccagcugucacgacggaaaggcuuggcugcaugugugcguuaccggcgaugacaaaaacgccacagcuucuuucaucuacaauggccgccuuguggauuccauugucagcuggucuaaggaaauccugagaacccaggaguccgagugugugugcauuaacgggaccuguacaguggucaugacggacggaagcgccuccggcaaagcggauaccaagauccucuuuaucgaagaggggaagauuguucacacaucuacccugagcggauccgcccaacacguggaagagugcagcugcuauccucgguaccccggcgugcgcugugucugcagagacaauuggaaagggucuaaccggccuaucguggauauuaacaucaaggacuacuccauuguuagccgcuauguguguucuggacuugucggcgacacaccccggaaaaaugauagcuccucuagcucccauugccuggacccgaacaaugaagagggcgggcacggagugaagggcugggcuuucgaugacgggaacgauguuuggaugggaagaaccaucagcgagaaaucucgcuccggcuacgaaacguuuaaggugaucgagggguggagcaauccuaacucuaaacuccagauuaauagacaggucaucguggaccggggaaaccgcuccggcuauagcggcauuuucuccgucgaagggaagucuuguaucaauagaugcuuuuacguggagcugauucggggaagaaaggaagagacagagguucuguggaccagcaacuccaucguggucuucuguggcaccucugggacauauggaaccggcagcuggcccgauggggccgacauuaaucucaugccuaucuga

SEQ ID NO: 204615 - RNA, 1410 nt, Artificial Sequence
  derived and/or modified sequence opt5 from neuraminidase__InfluenzaA__AEX36226
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacaaucggaccccguaucgcacgcuccugaugaacgaacugggcgugcccuuucaucucgggacaaagcaggucugcauugccuggucuagcuccagcugucacgacggaaaggcuuggcugcaugugugcguuaccggcgaugacaaaaaugccacagcuucuuucaucuacaacggcagacuuguggauuccauugucagcuggucuaaagagauccugcggacccaggaauccgagugugugugcauuaaugggaccuguacaguggucaugacggacggaagcgccuccggcaaggcggauaccaaaauccucuuuaucgaggaagggaagauuguucacacaucuacccugagcggauccgcccaacacguggaggaaugcagcugcuauccucgcuaccccggcgugagaugugucugccgggacaacuggaaggggucuaaccgcccuaucguggauauuaauaucaaagacuacuccauuguuagcagauauguguguucuggaaucgucggcgacacaccccggaagaacgauagcuccucuagcucccauugccuugacccgaauaacgaggaaggcgggcacggagugaaaggcugggcuuucgaugacgggaaugauguuuggaugggacgcaccaucagcgagaagucuagauccggcuacgagacguuuaaagugauugaaggguggagcaacccuaauucuaagcugcagaucaaccggcaggucauuguggaccgcggaaauagauccggcuauagcggcaucuucuccgucgaggggaaaucuuguauuaaccggugcuuuuacguggaacucaucagaggacgcaaggaggaaacagagguucuguggaccagcaauuccauuguggucuucuguggcaccucugggacauauggaaccggcagcuggcccgauggggccgacaucaaccugaugccuaucuga

SEQ ID NO: 204616 - RNA, 1410 nt, Artificial Sequence
  derived and/or modified sequence opt5 from neuraminidase__InfluenzaA__AEX36237
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaacgcacgccguauagaacacuccugaugaacgagcugggcgugcccuuucaccucgggaccaaacaggucugcauugccugguccagcagcuccugucaugauggaaaggccuggcugcacgugugcguuacaggcgacgauaaaaaugcuaccgccagcuucaucuacaacggccggcuuguggacucuauugucuccuggagcaaggaaauccugcgcacccaggagucugagugugugugcauuaaugggacauguacgguggucaugaccgauggauccgcuagcggcaaagccgacacaaagauccucuuuaucgaagaggggaagauuguucauaccuccacacugucuggaagcgcgcaacacguggaagagugcuccugcuauccuagauaccccggcgugcggugugucugccgcgauaacuggagagggagcaaccggccuaucguggacauuaauaugaaagauuacucuaucguuuccagcuauguguguucuggacuugucggcgacacgccccgcaagaacgacagcuccucuagcggccacugccuggauccgaaugacgaagaagggggacauggcgugaaagggugggccuucgaugacggaaacgauguuuggaugggcagaaccauuuccgagaagucucggucuggguacgagacauuuaaagugaucgagggaugguccaauccuaacagcaagcuccagaucaaucgccaggucauuguggacagaggcaaccggucuggcuauuccgggaucuucagcgucgaaggaaaauccuguauuaauagaugcuuuuacguggagcugauccgcggccggaaggaagagaccgagguucuguggaccucuaacagcauuguggucuucugugggacauccggaaccuauggcacagggucuuggcccgauggcgcugacaucaaucucaugccuauuuga

SEQ ID NO: 204617 - RNA, 1410 nt, Artificial Sequence
  derived and/or modified sequence opt5 from neuraminidase__InfluenzaA__AEX36248
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacaaucggaccccguaucgcacgcuccugaugaacgaacugggcgugcccuuucaucucgggacaaagcaggucugcauugccuggucuagcuccagcugucacgacggaaaggcuuggcugcaugugugcguuaccggcgaugacaaaaaugccacagcuucuuucaucuacaacggcagacuuguggauuccauugucagcuggucuaaagagauccugcggacccaggaauccgagugugugugcauuaaugggaccuguacaguggucaugacggacggaagcgccuccggccgcgcggauaccaagauccucuuuaucgaggaagggaaaauuguucacacaucuacccugagcggauccgcccaacacguggaggaaugcagcugcuauccuagauaccccggcgugcggugugucugccgcgacaacuggaaggggucuaacagaccuaucguggauauuaauaucaaggacuacuccauuguuagccgguauguguguucuggacuugucggcgacacaccccgcaaaaacgauagcuccucuagcucccauugccuggacccgaauaacgaggaaggcgggcacggagugaagggcugggcuuucgaugacgggaaugauguuuggaugggaagaaccaucagcgagaaaucucgguccggcuacgagacguuuaaggugaucgaaggguggagcaacccuaauucuaaacuccagauuaaccgccaggucaucguggacagaggaaaucgguccggcuauagcggcauuuucuccgucgaggggaagucuuguaucaacagaugcuuuuacguggaacugauucgcggacggaaagaggaaacagagguucuguggaccagcaauuccaucguggucuucuguggcaccucugggacauauggaaccggcagcuggcccgauggggccgacauuaaccucaugccuaucuga

SEQ ID NO: 204618 - RNA, 1410 nt, Artificial Sequence; identical to SEQ ID NO: 199536
  derived and/or modified sequence opt5 from neuraminidase__InfluenzaA__AEX36259

SEQ ID NO: 204619 - RNA, 1410 nt, Artificial Sequence
  derived and/or modified sequence opt5 from neuraminidase__InfluenzaA__AEX36270
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacggccggaccccguaucgcacgcuccugaugaaugaacugggggugcccuuucaucucggaacaaagcaggucugcauugccuggucuagcuccagcugucacgacggcaaggcuuggcugcaugugugcguuaccggcgaugacaaaaacgccacagcuucuuucaucuacaaugggagacuuguggauuccauugucagcuggucuaaagagauccugcggacccaggaauccgagugugugugcauuaacggaaccuguacaguggucaugacggacggcagcgccuccgggaaggcggauaccaaaauccucuuuaucgaggaaggaaagauuguucacacaucuacccugagcggcuccgcccaacacguggaggaaugcagcugcuauccucgcuaccccggggugagaugugucugccgggacaauuggaagggaucuaaccgcccuaucguggauauuaacaucaaagacuacuccauuguuagcagauauguguguucuggccuugucggcgacacaccccggaagaaugauagcuccucuagcucccauugccuggacccgaacaaugaggaagggggacacggcgugaaagggugggcuuucgaugacggaaacgauguuuggaugggccgcaccaucagcgagaagucuagauccggguacgagacguuuaaagugaucgaaggauggagcaauccuaacucuaagcuccagauuaaucggcaggucaucguggaccgcggcaacagauccggcuauagcgggauuuucuccgucgagggaaaaucuuguaucaaucggugcuuuuacguggaacugauuagaggccgcgaggaagagacaaagguucuguggaccagcaacuccaucguggucuucugugggaccucuggaacauauggcaccgggagcuggcccgauggcgccgacauuaaucucaugccuaucuga

SEQ ID NO: 204620 - RNA, 1410 nt, Artificial Sequence
  derived and/or modified sequence opt5 from neuraminidase__InfluenzaA__AEX36281
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacggccggaccccguaucgcacgcuccugaugaaugaacugggggugcccuuucaucucggaacaaagcaggucugcauugccuggucuagcuccagcugucacgacggcaaggcuuggcugcaugugugcguuaccggcgaugacaaaaacgccacagcuucuuucaucuacaaugggagacuuguggauuccauugucagcuggucuaaagagauccugcggacccaggaauccgagugugugugcauuaacggaaccuguacaguggucaugacggacggcagcgccuccgggaaggcggauaccaaaauccucuuuaucgaggaaggaaagauuguucacacaucuacccugagcggcuccgcccaacacguggaggaaugcagcugcuauccucgcuaccccggggugagaugugucugccgggacaauuggaagggaucuaaccgcccuaucguggauauuaacaucaaagacuacuccauuguuagcagauauguguguucuggccuugucggcgacacaccccggaagaaugauagcuccucuagcucccauugccuggacccgaacaaugaggaagggggacacggcgugaaagggugggcuuucgaugacggaaacgauguuuggaugggccgcaccaucagcgagaagucuagauccggguacgagacguuuaaagugaucgaaggauggagcaauccuaacucuaagcuccagauuaaucggcaggucaucguggaccgcggcaacagauccggcuauagcgggauuuucuccgucgagggaaaaucuuguaucaaucggugcuuuuacguggaacugauuagaggccgcaaggaggaaacagagguucuguggaccagcaacuccaucguggucuucugugggaccucuggaacauauggcaccgggagcuggcccgauggcgccgacauuaaucucaugccuaucuga

SEQ ID NO: 204621 - RNA, 1410 nt, Artificial Sequence; identical to SEQ ID NO: 204620
  derived and/or modified sequence opt5 from neuraminidase__InfluenzaA__AEX36292

SEQ ID NO: 204622 - RNA, 1410 nt, Artificial Sequence
  derived and/or modified sequence opt5 from neuraminidase__InfluenzaA__AEX36303
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacgaacggaccccguaucgcacgcuccugaugaaugagcugggcgugcccuuucaucucgggacaaagcaggucugcauugccuggucuagcuccagcugucacgacggaaaggcuuggcugcaugugugcguuaccggcgaugacaaaaacgccacagcuucuuucaucuacaauggcagacuuguggauuccauugucagcuggucuaaagaaauccugcggacccaggaguccgagugugugugcauuaacgggaccuguacaguggucaugacggacggaagcgccuccggcaaggcggauaccaaaauccucuuuaucgaagaggggaagauuguucacacaucuacccugagcggauccgcccaacacguggaagagugcagcugcuauccucgcuaccccggcgugagaugugucugccgggacaauuggaaggggucuaaccgcccuaucguggauauuaacaucaaagacuacuccauuguuagcagauauguguguucuggacuugucggcgacacaccccggaagaaugauagcuccucuagcucccauugccuggacccgaacaaugaagagggcgggcacggagugaaaggcugggcuuucgaugacgggaacgauguuuggaugggacgcaccaucagcgagaagucuagauccggcuacgaaacguuuaaagugaucgagggguggagcaauccuaacucuaagcuccagauuaaucggcaggucaucguggaccgcggaaacagauccggcuauagcggcauuuucuccgucgaagggaaaucuuguaucaaucggugcuuuuacguggagcugauuagaggacgcaaggaagagacagagguucuguggaccagcaacuccaucguggucuucuguggcaccucugggacauauggaaccggcagcuggcccgauggggccgacauuaaucucaugccuaucuga

SEQ ID NO: 204623 - RNA, 1410 nt, Artificial Sequence
  derived and/or modified sequence opt5 from neuraminidase__InfluenzaA__AEX36314
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacaaucggacgccguaucgcacacuccugaugaacgaacugggcgugcccuuucaucucgggaccaagcaggucugcauugccuggucuagcuccagcugucacgacggaaaagccuggcugcaugugugcguuacaggcgaugacaagaaugcuaccgccucuuucaucuacaacggcagacuuguggauuccauugucagcuggucuaaagagauccugcggacccaggaauccgagugugugugcauuaaugggacaugugcuguggucaugacggacggaagcgccuccggcaaggcggauaccaaaauccucuuuaucgaggaagggaagauuguucacacaucuacccugagcggauccgcccaacacguggaggaaugcagcugcuauccucgcuaccccggcgugagaugugucugccgggacaacuggaaggggucuaaccgcccuaucguggauauuaauaucaaagacuacuccauuguuagcagauauguguguucuggacuugucggcgacacaccccggaagaacgauagcuccucuagcucccauugccuggacccgaauaacgaggaaggcgaucacggggugaaaggaugggcuuucgacgauggcaaugacguuuggauggggcgcaccaucagcgagaagucuagauccggauacgagacguuuaaagugaucgaaggcuggagcaacccuaauucuaagcuccagauuaaccggcaggucaucguggaucgcgggaauagauccggauauagcggcauuuucuccgucgagggcaaaucuuguaucaaccggugcuuuuacguggaacugauuagagggcgcaaggaggaaacagagguucuguggaccagcaauuccaucguggucuucuguggaaccucuggcacauaugggaccggaagcuggcccgacggcgccgagauuaaccucaugccuaucuga

SEQ ID NO: 204624 - RNA, 1410 nt, Artificial Sequence; identical to SEQ ID NO: 204620
  derived and/or modified sequence opt5 from neuraminidase__InfluenzaA__AEX36336

SEQ ID NO: 204625 - RNA, 1410 nt, Artificial Sequence
  derived and/or modified sequence opt5 from neuraminidase__InfluenzaA__AEX36347
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccauuaucauugagagaaacaucacagaaauuguguaucugaccaauacaaccaucgagaaggaaauuugcccuaaacucgcugaguaccggaacuggucuaagccccagugugacaucacgggguucgccccuuuuagcaaagauaauuccauccgccugucugcgggaggcgacauuugggugaccagagagcccuaugucagcugcgauccugacaaguguuaccaauucgcucuugggcagggaacaacccugaacaaugugcauuccaacgauacaguucacaaucggaccccguaucgcacgcuccugaugaacgaacugggcgugcccuuucaucucgggacaaagcaggucugcaucgccuggucuagcuccagcugucacgacggaaaagccuggcugcaugugugcguuaccggcgaugacaagaaugcuacagccucuuucauuuacaacggcagacuuguggauuccaucgucagcuggucuaaagagauucugcggacccaggaauccgagugugugugcaucaaugggaccugugcuguggucaugacagacggaagcgccuccggcaaggcggauacgaaaauccucuuuauugaggaagggaagaucguucacgccucuacccugagcggauccgcucaacacguggaggaaugcagcugcuauccucgcuaccccggcgugagaugugucugccgggacaacuggaaggggucuaaccgcccuauuguggauaucaauauuaaagacuacuccaucguuagcagauauguguguucuggacuugucggcgacacaccccggaagaacgauagcuccucuagcucccauugccuggacccgaauaacgaggaaggcgggcacggagugaaaggcugggccuucgaugacgggaaugauguuuggaugggacgcaccaucagcgagaagucuagauccggcuacgagacauuuaaagugauugaaggguggagcaacccuaauucuaagcuccagaucaaccggcaggucauuguggaccgcggaaauagauccggcuauagcggcaucuucuccgucgaggggaaaucuuguauuaaccggugcuuuuacguggaacugaucagaggacgcaaggaggaaaccgagguucuguggacgagcaauuccauuguggucuucuguggcacaucugggaccuauggaaccggcagcuggcccgauggggcugacaucaaccucaugccuaucuga

SEQ ID NO: 204626 - RNA, 1410 nt, Artificial Sequence; identical to SEQ ID NO: 198908
  derived and/or modified sequence opt5 from neuraminidase__InfluenzaA__AEX36358

SEQ ID NO: 204627 - RNA, 1410 nt, Artificial Sequence
  derived and/or modified sequence opt5 from neuraminidase__InfluenzaA__AEX36369
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggaaccgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccggggaaauagaaccggcuacucuggcaucuucuccguggaggggaagucuuguauuaaccggugcuuuuaugucgaacugaucagaggacgcaaggaggaaaccgaggugcucuggacauccaauucuauuguuguguucuguggcaccagcgggacauacggaacgggcuccuggcccgauggggcugacaucaaccugaugccuaucuga

SEQ ID NO: 204628 - RNA, 1410 nt, Artificial Sequence
  derived and/or modified sequence opt5 from neuraminidase__InfluenzaA__AEX36391
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauugccggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaaugauacaguucggaaccgcaccccguauagaacgcuccugaugaaugaacugggcgugcccuuucaccucgggacaaagcaggucugcauugccugguccucuagcuccugucaugacggaaaggcuuggcugcacgugugcaucaccggcgaugacaaaaacgccacagcuagcuucauuuacaauggccggcuuguugauucuaucguguccuggagcaaagagauucugcgcacccaggaaucugagugugucugcaucaacgggaccuguacaguggugaugacggacggauccgccagcggcaaggcggauaccaaaauccucuuuauugaggaagggaagaucguccauacauccacccugucuggaagcgcccaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacaccccggaagaaugauagcuccucuagcucccauugccuggacccgaacaaugaggaaggcgggcacggagucaaaggcugggcuuucgaugacgggaacgauguguggaugggacgcaccaucagcgagaagucuagacucggcuaugagacguuuaaaguuauugaagggugguccaauccuaagagcaaacugcagaucaaccgccaggugauugucgaccggggagauagaucuggcuacuccggcaucuucagcguggaggggaaguccuguauuaaucggugcuuuuaugucgaacugaucagaggacgcaaggaggaaacagaggugcucuggaccucuaacagcauuguuguguucuguggcaccuccgggacauacggaaccggcucuuggcccgacggggccgauaucaaucugaugccuaucuga

SEQ ID NO: 204629 - RNA, 1410 nt, Artificial Sequence
  derived and/or modified sequence opt5 from neuraminidase__InfluenzaA__AEX36402
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggggccgcacgccguauagaacacuccugaugaacgaacugggggugcccuuucaccucggaaccaagcaggucugcauugccugguccucuagcuccugucaugacggcaaagccuggcugcacgugugcaucacaggcgaugacaagaaugcuaccgccagcuucauuuacaacgggcggcuuguugauucuaucguguccuggagcaaagagauucugcgcacccaggaaucugagugugucugcaucaauggaacauguacgguggugaugaccgacggcuccgcuagcgggaaggccgauacaaaaauccucuuuauugaggaaggaaagaucguccauaccuccacacugucuggcagcgcgcaacacguugaggaaugcuccugcuauccuagauuccccggggugcggugugugugccgcgacaacuggaagggaagcaacagaccuauugucgauaucaauauuaaagaccacucuaucguguccagcuacguuuguucuggccuugugggcgacacgccccggaagaacgauagcuccucuagcucccauugccuggacccgaauaacgaggaagggggacacggcgucaaagggugggccuuugaugacggaaaugauguguggaugggccgcaccaucagcgagaagucuagacucggguacgagacauucaaaguuauugaaggaugguccaacccuaagagcaaacugcagaucaaucgccaggugauugucgaccggggcaacagaaccggcuauucugggaucuuuuccguggagggaaagagcuguauuaaucggugcuucuacgucgaacugaucagaggccgcaaggaggaaaccgaggugcucuggacauccaacucuauuguuguguucugugggaccagcggaacauauggcacgggguccuggcccgauggcgcugacaucaaucugaugccuaucuga

SEQ ID NO: 204630 - RNA, 1410 nt, Artificial Sequence; identical to SEQ ID NO: 198908
  derived and/or modified sequence opt5 from neuraminidase__InfluenzaA__AEX36413

SEQ ID NO: 204631 - RNA, 1410 nt, Artificial Sequence
  derived and/or modified sequence opt5 from neuraminidase__InfluenzaA__AEX36424
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcuccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaaugauaccauucgggaccgcacgccuuauagaacacuccugaugaacgaacugggcguuccguuucaccucgggaccaaacaggugugcaucgccuggucuagcuccagcugucaugauggaaaggccuggcugcacgucugcauuacaggcgacgauaagaaugcuaccgccucuuucaucuacaacggccggcuuguggacuccguugugagcuggucuaaagagauucugcgcacccaggaauccgagugugucugcaucaaugggacauguacgguggugaugaccgauggaagcgcuuccggcaaggccgacacaaaaauccucuuuauugaggaagggaagaucguccauaccucuacacugagcggauccgcgcaacacguugaggaaugcagcugcuaucccagauacccuggcgugcggugugugugccgcgauaacuggaaggggucuaacagacccauugucgacaucaauauuaaagaccacuccaucgugagcucuuacguuuguagcggacuugugggcgauaccccucggaagaacgacuccucuagcuccagccauugccuggaucccaauaacgaggaaggcgggcacggagucaaaggcugggccuucgacgaugggaaugacguguggaugggacgcacgaucucugagaaguccagacucggcuaugagacauuuaaaguuauugaaggguggagcaacccgaagucuaaacugcagaucaaucgccaggugauugucgaucggggaaacagauccggcuacagcggcaucuucuccguggaggggaagucuuguauuaaucggugcuuuuaugucgaacugaucagaggacgcaaggaggaaaccgaggugcucuggaccagcaacuccauuguuguguucuguggcacaucugggaccuacggaacaggcagcuggccugacggggcugauaucaaucugaugcccaucuga

SEQ ID NO: 204632 - RNA, 1410 nt, Artificial Sequence
  derived and/or modified sequence opt5 from neuraminidase__InfluenzaA__AEX36435
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucaaggaggggaagauuguucauaccuccacacugucuggaagcgcgcaacacguggaagagugcuccugcuauccuagauaccccggcgugcggugugucugccgcgauaacuggaaagggagcaacagaccuaucguggacauuaauaucaaggaccacucuauuguuuccagcuacguguguucuggacuugucggcgauacgccccggaaaaacgacagcuccucuagcucccauugccuggauccgaauaacgaagagggcgggcacggagugaagggcugggccuucgacgaugggaaugacguuuggaugggacgcaccaucagcgaaaaaucuagacucggcuaugagacauuuaaggugaucgaggggugguccaacagcaaaucuaagcugcagauuaaucggcaggucaucguggaucgcggaaacagauccggcuacagcggcauuuucuccgucgaagggaagucuuguaucaaucggugcuuuuauguggagcugauuagaggacgcaaagaagagaccgaaguucucuggaccagcaacuccaucguggucuucuguggcacaucugggaccuacggaacaggcagcuggccugacggggcugauauuaaucugaugcccaucuga

SEQ ID NO: 204633 - RNA, 1410 nt, Artificial Sequence; identical to SEQ ID NO: 199090
  derived and/or modified sequence opt5 from neuraminidase__InfluenzaA__AEX36446

SEQ ID NO: 204634 - RNA, 1410 nt, Artificial Sequence; identical to SEQ ID NO: 199090
  derived and/or modified sequence opt5 from neuraminidase__InfluenzaA__AEX36457

SEQ ID NO: 204635 - RNA, 1410 nt, Artificial Sequence
  derived and/or modified sequence opt5 from neuraminidase__InfluenzaA__AEX36468
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacaaucggacgccguaucgcacacuccugaugaacgaacugggcgugcccuuucaucucgggaccaagcaggucugcauugccuggagcagcuccagcugucacgacggaaaagccuggcugcaugugugcguuacaggcgaugacaagaaugcuaccgccucuuucaucuacaacggcagacuuguggauuccauugucagcuggucuaaagagauccugcggacccaggaauccgagugugugugcauuaaugggacauguacgguggucaugaccgacggaagcgcuuccggcaaggccgauacaaaaauccucuuuaucgaggaagggaagauuguucacaccucuacacugagcggaaacgcgcaacacguggaggaaugcuccugcuauccucgcuaccccggcgugagaugugucugccgggacaacuggaaggggagcaaucgcccuaucguggauauuaacaucaaagacuacucuauuguuuccagauauguguguagcggacuugucggcgacacgccccggaagaaugauucuagcuccucuagccauugccuggacccgaacaaugaggaaggcgggcacggagugaaaggcugggccuucgaugacgggaacgauguuuggaugggacgcaccaucuccgagaagucuagaucuggcuacgagacauuuaaagugaucgaagggugguccaauccuaacagcaagcuccagauuaaucggcaggucaucguggaccgcggaaacagaucuggcuauuccggcauuuucagcgucgaggggaaauccuguaucaaucggugcuuuuacguggaacugauuagaggacgcaaggaggaaaccaagguucuguggaccucuaacagcaucguggucuucuguggcacauccgggaccuauggaacaggcucuuggcccgauggggcugacauuaaucucaugccuaucuga

SEQ ID NO: 204636 - RNA, 1410 nt, Artificial Sequence
  derived and/or modified sequence opt5 from neuraminidase__InfluenzaA__AEX36479
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguauccuacaaauaccacgaccgagaaggaaauuugccccaaacuggcugaguaccggaacuggucuaagccucagugugacaucacaggguucgcccccuuuagcaaagauaauuccauucgccucucugcgggaggcgacaucugggugaccagagagccuuaugucagcugcgauccggacaaguguuaccaauucgcucuggggcagggaacaacccuuaacaaugugcauuccaacgauacgguucacgaccggacacccuaucgcacccugcucaugaaugaacugggcgugccuuuucaucuggggacaaagcaggucugcaucgccuggucuagcuccagcugucacgauggaaaagccuggcuccaugugugcguuaccggcgacgauaagaacgcuaccgccucuuucauuuacaauggcagacugguggacuccaucgucagcuggucuaaagagauucuucggacacaggaauccgagugugugugcaucaacgggacguguaccguggucaugacagauggaagcgcuuccggcaaggccgacaccaaaauucuguuuaucgaggaagggaagaucguucacacaucuacccucagcggauccgcgcaacacguggaggaaugcagcugcuauccccgcuacccuggcgugagaugugucugccgggauaauuggaaggggucuaaccgccccauuguggacaucaacauuaaagacuacuccaucguuagcagauauguguguucuggacuggucggcgauacgccgcggaagaaugacagcuccucuagcucccauugccuugauccuaacaaugaggaaggcgggcacggagugaaaggcugggccuucgacgaugggaacgacguuuggaugggacgcacaauuagcgagaagcugagaucuggcuacgagaccuuuaaagugaucgaagggugguccaaucccaacagcaagcuccagaucaaucggcaggucauuguggaucgcggaaacagaucuggcuauuccggcaucuucagcgucgaggggaaauccuguauuaaucggugcuuuuacguggaacugaucagaggacgcaaggaggaaaccgagguucuguggacaucuaacagcauuguggucuucuguggcaccuccgggacauauggaacgggcucuuggccugacggggcugauaucaaucucaugcccauuuga

SEQ ID NO: 204637 - RNA, 1410 nt, Artificial Sequence
  derived and/or modified sequence opt5 from neuraminidase__InfluenzaA__AEX36490
augaaccccaaucagaagaucauuaccaucggcagcgugucccugacaauuucuacgaucugcuucuuuaugcaaauugccauccucaucaccacagucacccugcacuucaaacaguacgaguuuagcuauccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacgauaccguucacgaccggacgccguaccgcacacuccugaugaaugaacugggcgugcccuuucaucucgggaccaagcaggucugcauugccugguccucuagcuccugucacgauggaaaagccuggcugcaugugugcguuacaggcgacgauaagaacgcuaccgccagcuucaucuauaauggcagacuuguggacucuauugucuccuggagcaaagagauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaaaugcgcaacacguggaggaaugcagcugcuacccucgcuaccccggcgugagaugugucugccgggauaacuggaagggguccaaccgcccuaucguggacauuaauaucaaagacuauagcauuguuucuagauacguguguuccggacuugucggcgauacgccccggaagaacgacagcucuagcuccucucauugccuggauccgaauaacgaggaaggcgggcacggagugaaaggcugggccuucgacgaugggaaugacguuuggaugggacgcaccaucagcgagaaguccagaagcggcuaugagacauuuaaagugaucgaaggguggucuaacccuaauuccaagcuccagauuaaccggcaggucaucguggaucgcggaaauagaagcggcuacucuggcauuuucuccgucgaggggaaaagcuguaucaaccggugcuuuuauguggaacugauuagaggacgcaaggaggaaaccaagguucuguggaccuccaauucuaucguggucuucuguggcacaagcgggaccuacggaacaggcuccuggcccgacggggcugauauuaaccucaugccuaucuga

SEQ ID NO: 204638 - RNA, 1410 nt, Artificial Sequence
  derived and/or modified sequence opt5 from neuraminidase__InfluenzaA__AEX36501
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaaaugcccuaagcucgccgaguaccggaacuggucuaaaccccagugugacaucacgggguucgcgccuuuuagcaaggauaauuccauucgccugucugcuggaggcgacaucugggugaccagagagcccuaugucagcugcgauccugacaaguguuaccaauucgcccuugggcagggaacaacccugaacaaugugcauuccaacgauacaguucacggccggaccccguaucgcacgcuccugaugaaugaacugggggugcccuuucaucucggaacaaaacaggucugcaucgccuggucuagcuccagcugucacgacggcaaggcuuggcugcaugugugcguuaccggcgaugacaaaaacgccacagcuucuuucauuuacaaugggagacuuguggauuccaucgucagcuggucuaaggagauucugcggacccaggaauccgagugugugugcaucaacggaaccuguacaguggucaugacggacggcagcgccuccgggaaagcggauaccaagauucucuuuaucgaggaaggaaagaucguucacacaucuacccugagcggcuccgcccaacacguggaggaaugcagcugcuauccucgcuaccccggggugagaugugucugccgggacaauuggaaaggaucuaaccgcccuauuguggauaucaacauuaaggacuacuccaucguuagcagauauguguguucuggccuugucggcgacacaccccggaaaagcgauuccucuagcuccagccauugccuggacccgaauaacgaggaagggggacacggcgugaaggggugggcuuucgaugacggaaaugauguuuggaugggccgcaccauuucugagaaauccagaagcggguacgagacguuuaaggugaucgaaggauggucuaacccuaauuccaaacuccagaucaaccggcaggucauuguggaccgcggcaauagaagcggcuauuccgggaucuucucugucgagggaaagagcuguauuaaccggugcuuuuacguggaacugaucagaggccgcaaggaggaaacagagguucuguggaccuccaauucuauuguggucuucugugggaccagcggaacauauggcaccggguccuggcccgauggcgccgacaucaaccucaugccuauuuga

SEQ ID NO: 204639 - RNA, 1410 nt, Artificial Sequence
  derived and/or modified sequence opt5 from neuraminidase__InfluenzaA__AEX36512
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccgcuauuaucgagagaaacauuacagaaaucguguaucugaccaauacaaccauugagaaggaaaucugcccuaaacucgccgaguaccggaacuggucuaagccccagugugacauuacgggguucgcgccuuuuagcaaagauaauuccauccgccugucugcuggaggcgacaucugggugaccagagagcccuaugucagcugcgauccugacaaguguuaccaauucgcccuugggcagggaacaacccugaacaaugugcauuccaacgauacaguucacgaccggaccccguaucgcacgcuccugaugaaugaacugggcgugcccuuucaucucgggacaaagcaggucugcauugccuggucuagcuccagcugucacgauggaaaggcuuggcugcaugugugcguuaccggcgacgauaaaaacgccacagcuucuuucaucuacaauggcagacuuguggacuccauugucagcuggucuaaagagauccugcggacccaggaauccgagugugugugcauuaacgggaccuguacaguggucaugacggauggaagcgccuccggcaaggcggacaccaaaauccucuuuaucgaggaagggaagauuguucacacaucuacccugagcggauccgcccaacacguggaggaaugcagcugcuauccucgcuaccccggcgugagaugugucugccgggauaauuggaaggggucuaaccgcccuaucguggacauuaacaucaaagacuacuccauuguuagcagauauguguguucuggacuugucggcgauacaccccggaagaaugacagcuccucuagcucccauugccuggauccgaacaaugaggaaggcgggcacggagugaaaggcugggcuuucgacgaugggaacgacguuuggaugggacgcaccaucagcgagaagucuagauccggcuacgagacguuuaaagugaucgaaggguggagcaauccuaacucuaagcuccagauuaaucggcaggucaucguggaucgcggaaacagauccggcuauagcggcauuuucuccgucgaggggaaaucuuguaucaaucggugcuuuuacguggaacugauuagaggacgcaaggaggaaacagagguucuguggaccagcaacuccaucguggucuucuguggcaccucugggacauauggaaccggcagcuggcccgacggggccgauauuaaucucaugccuaucuga

SEQ ID NO: 204640 - RNA, 1410 nt, Artificial Sequence
  derived and/or modified sequence opt5 from neuraminidase__InfluenzaA__AEX36523
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcgaggccgacacaaagauccucuuuaucgaagaggggaaaauuguucauaccuccacacugucuggaagcgcgcaacacguggaagagugcuccugcuauccuagauaccccggcgugcggugugucugccgcgauaacuggaaggggagcaacagaccuaucguggacauuaauaucaaggaccacucuauuguuuccagcuacguguguucuggacuugucggcgauacgccccggaaaaacgacagcuccucuagcucccauugccuggauccgaauaacgaagagggcgggcacggagugaagggcugggccuucgacgaugggaaugacguuuggaugggacgcaccaucagcgagaaaucuagacucggcuaugaaacauuuaaggugaucgaggggugguccaacccuaaaagcaagcugcagauuaaucggcaggucaucguggaucgcggaaacagaucuggcuacuccggcauuuucagcgucgaagggaaauccuguaucaaucggugcuuuuauguggagcugauuagaggacgcaaggaagagaccgagguucucuggaccucuaacagcaucguggucuucuguggcacauccgggaccuacggaacaggcucuuggcccgacggggcugauauuaaucugaugccuaucuga

SEQ ID NO: 204641 - RNA, 1410 nt, Artificial Sequence; identical to SEQ ID NO: 199623
  derived and/or modified sequence opt5 from neuraminidase__InfluenzaA__AEX36534

SEQ ID NO: 204642 - RNA, 1410 nt, Artificial Sequence
  derived and/or modified sequence opt5 from neuraminidase__InfluenzaA__AEX36545
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcucucggcaaggccgacacaaaaauccuguuuaucgaggaagggaagauuguucauaccagcacacuuuccggaucugcgcaacacguggaggaaugcagcugcuauccuagauaccccggcgugcggugugucugccgcgauaacuggaagggguccaacagaccuaucguggacauuaauaucaaagaccacagcauuguuucuuccuacguguguagcggacuggucggcgauacgccccggaagaacgacucuagcuccucuagccauugccucgauccgaauaacgaggaaggcgggcacggagugaaaggcugggccuucgacgaugggaaugacguuuggaugggacgcaccaucuccgagaagucuagacugggcuaugagacauuuaaagugaucgaaggguggucuaacccuaaguccaaacugcagauuaaucggcaggucaucguggaucgcggaaacagaagcggcuacucuggcauuuucuccgucgagggaaagagcuguaucaaucggugcuuuuauguggaacucauuagagggcgcaaggaggaaaccgagguucuguggaccuccaacucuaucguggucuucuguggcacaagcgggaccuacggaacaggcuccuggcccgacggggcugauauuaaucuuaugccuaucuga

SEQ ID NO: 204643 - RNA, 1410 nt, Artificial Sequence; identical to SEQ ID NO: 199536
  derived and/or modified sequence opt5 from neuraminidase__InfluenzaA__AEX36556

SEQ ID NO: 204644 - RNA, 1410 nt, Artificial Sequence; identical to SEQ ID NO: 199536
  derived and/or modified sequence opt5 from neuraminidase__InfluenzaA__AEX36567

SEQ ID NO: 204645 - RNA, 1410 nt, Artificial Sequence
  derived and/or modified sequence opt5 from neuraminidase__InfluenzaA__AEX36578
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucaaggaggggaagauuguucauaccuccacacugucuggaagcgcgcaacacguggaagagugcuccugcuauccuagauaccccggcgugcggugugucugccgcgauaacuggaaagggagcaacagaccuaucguggacauuaauaucaaggaccacucuauuguuuccagcuacguguguucuggacuugucggcgauacgccccggaaaaacgacagcuccucuagcucccauugccuggauccgaauaacgaagagggcgggcacggagugaagggcugggccuucgacgaugggaaugacguuuggaugggacgcaccaucagcgaaaaaucuagacucggcuaugagacauuuaaggugaucgaggggugguccaacccuaaaagcaagcugcagauuaaucggcaggucaucguggaucgcggaaacagaucuggcuacuccggcauuuucagcgucgaagggaaguccuguaucaaucggugcuuuuauguggagcugauuagaggacgcaaagaagagaccgaaguucucuggaccucuaacagcaucguggucuucuguggcacauccgggaccuacggaacaggcucuuggcccgacggggcugauauuaaucugaugccuaucuga

SEQ ID NO: 204646 - RNA, 1410 nt, Artificial Sequence; identical to SEQ ID NO: 204645
  derived and/or modified sequence opt5 from neuraminidase__InfluenzaA__AEX36589

SEQ ID NO: 204647 - RNA, 1410 nt, Artificial Sequence
  derived and/or modified sequence opt5 from neuraminidase__InfluenzaA__AEX36600
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucaaggaggggaagauuguucauaccuccacacugucuggaagcgcgcaacacguggaagagugcuccugcuauccuagauaccccggcgugcggugugucugccgcgauaacuggaaagggagcaacagaccuaucguggacauuaauaucaaggaccacucuauuguuuccagcuacguguguucuggacuugucggcgauacgccccggaaaaacgacagcuccucuagcucccauugccuggauccgaauaacgaagagggcgggcacggagugaagggcugggccuucgacgaugggaauaacguuuggaugggacgcaccaucagcgaaaaaucuagacucggcuaugagacauuuaaggugaucgaggggugguccaauccuaaaagcaagcugcagauuaaccggcaggucaucguggaccgcggaaauagaucuggcuacuccggcauuuucagcgucgaagggaaguccuguaucaaccggugcuuuuauguggagcugauuagaggacgcaaagaagagaccgaaguucucuggaccucuaauagcaucguggucuucuguggcacauccgggaccuacggaacaggcucuuggcccgauggggcugacauuaaccugaugccuaucuga

SEQ ID NO: 204648 - RNA, 1410 nt, Artificial Sequence; identical to SEQ ID NO: 197738
  derived and/or modified sequence opt5 from neuraminidase__InfluenzaA__AEX36622

SEQ ID NO: 204649 - RNA, 1410 nt, Artificial Sequence
  derived and/or modified sequence opt5 from neuraminidase__InfluenzaA__AEX63619
augaaccccaaucagaagaucauuaccaucggcagcauuugcaugacaaucgggauugccucccugauccuccaaaucggaaacauuaucucuauuuggaucagccacuccauucagacggagaaucagaaccagccugaaaucuguaaucaaaacgugauuaccuacgagaauaacacaugggucaaucagaccuauguuaacgugucuaauacaaacuucguggcugaacaggccgucgcgagcgugaaacuggcuggcaauuccucucuuugcccgguuagcgggugggccaucuacuccaaggacaacagcgugagaaucggaucuaaaggcgaugucuuugugauucgggagcccuucaucuccuguagccauucugaaugccgcaccuuuuuccugacacagggggcccuccugaaugacaagcacuccaacggaaccauuaaagauagaagcccuuaucggacgcuuaugucuugucccaucggcgagguuccuucccccuacaacagccgcuuugaguccguggcuuggucugccagcgcuugccaugacggcaccuccuggcugacaauugggaucagcggaccugauaauggcgccgucgcggugcucaaguauaacgggaucauuaccgacacaaucaagucuuggcggaaaaauauucugagaacccaagaauccgagugugccugcgugaacggaagcuguuucacggucaugacagauggcccgucuaaugggcaggcuagcuacaagguuuuuaaaaucgaacgcggaaagguggugaaauccgucgagcugaacgcccccaauuaucacuacgaggaaugcucuuguuacccugagagcuccgaaauuaccugcgugugcagagacaacuggcauggcagcaaucggcccuggguuucuuucaaccagaaucucgaguaucagaugggcuacaucuguuccgggaucuuuggagauaacccucgccccaaugacaagacaggcagcugcgggccgguguucucuaacggagcuaauggcgucaagggguuuuccuucaaauauggaaacggcguguggauuggcagaaccaagagcaccuccucucggaugggguuugaaaugaucugggauccugacggauggacaaaaacggaugacaaguucagcguuaaacaagacauuaucggcauuaccgauugguccggguacucuggcagcuucgugcagcaccccgagcugacaggacuugacuguaugcgcccuugcuuuugggucgagcugaucagagggcggcccaaggaaaacaccauuuggacauccggcagcucuaucuccuucuguggagugaauagcgauaccgucggcuggucuuggcccgacggggccgagcucccuuuuacgaucgauaaauga

SEQ ID NO: 204650 - RNA, 1365 nt, Artificial Sequence; identical to SEQ ID NO: 198743
  derived and/or modified sequence opt5 from neuraminidase__InfluenzaA__AEX92876

SEQ ID NO: 204651 - RNA, 1365 nt, Artificial Sequence; identical to SEQ ID NO: 198743
  derived and/or modified sequence opt5 from neuraminidase__InfluenzaA__AEX92887

SEQ ID NO: 204652 - RNA, 1365 nt, Artificial Sequence; identical to SEQ ID NO: 198743
  derived and/or modified sequence opt5 from neuraminidase__InfluenzaA__AEX92904

SEQ ID NO: 204653 - RNA, 1365 nt, Artificial Sequence; identical to SEQ ID NO: 198743
  derived and/or modified sequence opt5 from neuraminidase__InfluenzaA__AEX96924

SEQ ID NO: 204654 - RNA, 1410 nt, Artificial Sequence; identical to SEQ ID NO: 201493
  derived and/or modified sequence opt5 from neuraminidase__InfluenzaA__AEY69091

SEQ ID NO: 204655 - RNA, 1410 nt, Artificial Sequence; identical to SEQ ID NO: 199623
  derived and/or modified sequence opt5 from neuraminidase__InfluenzaA__AEY69101

SEQ ID NO: 204656 - RNA, 1410 nt, Artificial Sequence; identical to SEQ ID NO: 199623
  derived and/or modified sequence opt5 from neuraminidase__InfluenzaA__AEY69112

SEQ ID NO: 204657 - RNA, 1410 nt, Artificial Sequence
  derived and/or modified sequence opt5 from neuraminidase__InfluenzaA__AEY69145
augaacaccaaucagaagaucauuacaaucggcagcgugucccugacgauuucuaccaucugcuucuuuaugcaaauugccauccucaucacaaccgucacacugcacuucaaacaguacgaguuuaacagcccgccuaauaaccagguuaugcuuugugaaccgaccauuaucgagagaaauauuacagaaaucguguaucugaccaacacgaccauugagaaggaaaucugccccaaacucgcugaguaccggaauugguccaagccucagugugacauuacaggguucgcccccuuuucuaaagauaacagcauccgccuguccgcgggaggcgacaucugggugaccagagagccuuaugucucuugcgaucccgacaaguguuaccaauucgcucuugggcagggaacaaccauuaauaacgugcauagcaauaacacgguucgggaucgcacaccuuauagaacccugcucaugaaugaacugggcgugccguuucaccuggggacaaagcaggucugcaucgccugguccucuagcuccugucaugacggaaaagccuggcuccacgugugcauuaccggcgaugacaagaacgcuaccgccagcuucaucuacaauggccggcugguugauucuguggucuccuggagcaaagagauucuucgcacacaggaaucugagugugugugcaucaacgggacguguaccguggucaugacagacggauccgcuagcggcaaggccgauaccaaaauccuguuuauugaggaagggaagaucguucauacauccacccucucuggaagcgcgcaacacguggaggaaugcuccugcuaucccagauacccuggcgugcggugugucugccgcgacaacuggaaggggagcaauagacccauuguggauaucaacaugaaagaccacucuauuguuuccagcuacguguguucuggacuggucggcgacacgccucggaagaaugauagcuccucuagcucccauugccuugaccccaacaaugaggaaggcgggcacggagugaaaggcugggccuucgaugacgggaacgauguuuggaugggacgcacaaucagcgagaagucuagacugggcuaugagaccuuuaaagugaucgaagggugguccaaucccaagagcaaacuccagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucuguggacaucuaauagcguggucguguucuguggcaccuccgggacauacggaacgggcucuuggccugauggggcugacaucaaccucaugcccauuuga

SEQ ID NO: 204658 - RNA, 1410 nt, Artificial Sequence; identical to SEQ ID NO: 199623
  derived and/or modified sequence opt5 from neuraminidase__InfluenzaA__AEY69156

SEQ ID NO: 204659 - RNA, 1410 nt, Artificial Sequence
  derived and/or modified sequence opt5 from neuraminidase__InfluenzaA__AEY69167
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaaccugaugccuguguga

SEQ ID NO: 204660 - RNA, 1410 nt, Artificial Sequence; identical to SEQ ID NO: 204659
  derived and/or modified sequence opt5 from neuraminidase__InfluenzaA__AEY69178

SEQ ID NO: 204661 - RNA, 1410 nt, Artificial Sequence; identical to SEQ ID NO: 204659
  derived and/or modified sequence opt5 from neuraminidase__InfluenzaA__AEY69189

SEQ ID NO: 204662 - RNA, 1410 nt, Artificial Sequence
  derived and/or modified sequence opt5 from neuraminidase__InfluenzaA__AEY69211
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucagcgaaaaaucuagacucggcuaugagacauuuaaggugaucgaggggugguccaauccuaaaagcaagcugcagauuaaccggcaggucaucguggaccgcggaaauagaucuggcuacuccggcauuuucagcgucgaagggaaguccuguaucaaccggugcuuuuauguggagcugauuagaggacgcaaagaagagaccgaaguucucuggaccucuaauagcaucguggucuucuguggcacauccgggaccuacggaacaggcucuuggcccgauggggcugacauuaaccugaugccuguguga

SEQ ID NO: 204663 - RNA, 1410 nt, Artificial Sequence; identical to SEQ ID NO: 204659
  derived and/or modified sequence opt5 from neuraminidase__InfluenzaA__AEY69233

SEQ ID NO: 204664 - RNA, 1410 nt, Artificial Sequence; identical to SEQ ID NO: 204659
  derived and/or modified sequence opt5 from neuraminidase__InfluenzaA__AEY69272

SEQ ID NO: 204665 - RNA, 1410 nt, Artificial Sequence; identical to SEQ ID NO: 204659
  derived and/or modified sequence opt5 from neuraminidase__InfluenzaA__AEY69283

SEQ ID NO: 204666 - RNA, 1410 nt, Artificial Sequence
  derived and/or modified sequence opt5 from neuraminidase__InfluenzaA__AEY69294
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugaauaacgugcauagcaauaacacgguucgggaucgcacaccguacagaacccuccugaugaaugaacugggcgugcccuuucaccucgggacaaagcaggucuguaucgccugguccucuagcuccugccaugacggaaaagccuggcugcacguguguauuaccggcgaugacaagaacgcuaccgccagcuucaucuauaauggccggcuuguugauucuguggucuccuggagcaaagagauucugcgcacacaggaaucugagugcguguguaucaacgggacgugcaccguggucaugacagacggauccgcuagcggcaaggccgauaccaaaauucucuuuaucgaggaagggaagaucguucauacauccacccugucuggaagcgcgcaacacguggaggaaugcuccuguuacccuagauaucccggcgugcggugcgucugucgcgacaacuggaaggggagcaauagaccuauuguggauaucaacauuaaagaccacucuaucguuuccagcuacgugugcucuggacuugucggcgacacgccccggaagaaugauagcuccucuagcucccauugucuggacccgaacaaugaggaaggcgggaacggagugaaaggcugggccuucgaugacgggaaugauguuuggaugggacgcacaauuagcgagaagucuagacucggcuacgagaccuuuaaagugaucgaagggugguccaacccuaagagcaaacugcagaucaaucggcaggucauuguggaccgcggaaacagaucuggcuauuccggcaucuucagcgucgaggggaaguccugcauuaaucgguguuuuuacguggaacugaucagaggacgcaaggaggaaaccgagguucucuggacaucuaacagcauuguggucuucugcggcaccuccgggacauauggaacgggcucuuggcccgauggggcugacaucaaucugaugccuauuuga

SEQ ID NO: 204667 - RNA, 1410 nt, Artificial Sequence; identical to SEQ ID NO: 204666
  derived and/or modified sequence opt5 from neuraminidase__InfluenzaA__AEY69305

SEQ ID NO: 204668 - RNA, 1410 nt, Artificial Sequence; identical to SEQ ID NO: 204666
  derived and/or modified sequence opt5 from neuraminidase__InfluenzaA__AEY69316

SEQ ID NO: 204669 - RNA, 1410 nt, Artificial Sequence; identical to SEQ ID NO: 204666
  derived and/or modified sequence opt5 from neuraminidase__InfluenzaA__AEY69788

SEQ ID NO: 204670 - RNA, 1410 nt, Artificial Sequence; identical to SEQ ID NO: 199623
  derived and/or modified sequence opt5 from neuraminidase__InfluenzaA__AEY69799

SEQ ID NO: 204671 - RNA, 1410 nt, Artificial Sequence; identical to SEQ ID NO: 199623
  derived and/or modified sequence opt5 from neuraminidase__InfluenzaA__AEY69810

SEQ ID NO: 204672 - RNA, 1410 nt, Artificial Sequence; identical to SEQ ID NO: 204659
  derived and/or modified sequence opt5 from neuraminidase__InfluenzaA__AEY69832

SEQ ID NO: 204673 - RNA, 1410 nt, Artificial Sequence
  derived and/or modified sequence opt5 from neuraminidase__InfluenzaA__AEY69843
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucgcuggcgaugacaagaacgccacagcuagcuucauuuacaauggccggcuuguugauucuguggucuccuggagcaaagagauccugcgcacccaggaaucugagugugugugcauuaacgggaccuguacaguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucagcgagaagucuagacucggcuaugagacguuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaacagagguucucuggaccucuaauagcaucguggucuucuguggcaccuccgggacauacggaaccggcucuuggcccgauggggccgacauuaaccugaugccuguguga

SEQ ID NO: 204674 - RNA, 1410 nt, Artificial Sequence; identical to SEQ ID NO: 204659
  derived and/or modified sequence opt5 from neuraminidase__InfluenzaA__AEY69854

SEQ ID NO: 204675 - RNA, 1410 nt, Artificial Sequence; identical to SEQ ID NO: 204659
  derived and/or modified sequence opt5 from neuraminidase__InfluenzaA__AEY69876

SEQ ID NO: 204676 - RNA, 1410 nt, Artificial Sequence; identical to SEQ ID NO: 204659
  derived and/or modified sequence opt5 from neuraminidase__InfluenzaA__AEY69887

SEQ ID NO: 204677 - RNA, 1410 nt, Artificial Sequence; identical to SEQ ID NO: 204659
  derived and/or modified sequence opt5 from neuraminidase__InfluenzaA__AEY69898

SEQ ID NO: 204678 - RNA, 1410 nt, Artificial Sequence; identical to SEQ ID NO: 199623
  derived and/or modified sequence opt5 from neuraminidase__InfluenzaA__AEY69909

SEQ ID NO: 204679 - RNA, 1410 nt, Artificial Sequence
  derived and/or modified sequence opt5 from neuraminidase__InfluenzaA__AEY69942
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgacggaggcgauaucugggugacaagagagcccuaugucucuugcgacccugauaaguguuaccaauucgcgcuugggcagggaaccacacugaauaacauucauagcaauaacaccgugcgggaccgcacgccguauagaacacuccugaugaaugaacugggcguucccuuucaccucgggaccaaacaggugugcaucgcuugguccucuagcuccugucaugauggaaaggccuggcugcacgucugcauuacaggcgacgauaagaacgccaccgcuagcuucaucuacaauggccggcuuguggacucuguuguguccuggagcaaagagauucugcgcacccaggaaucugagugugucugcaucaacgggacauguacgguggugaugaccgauggauccgccagcggcaaggcugacacaaaaauccucuuuauugaggaagggaagaucguccauaccuccacacugucuggaagcgcccaacacguugaggaaugcuccugcuauccuagauaccccggcgugcggugugugugccgcgauaacuggaaggggagcaauagaccuauugucgacaucaacauuaaagaccacucuaucguguccagcuacguuuguucuggacuugugggcgauacgccccggaagaaugacagcuccucuagcucccauugccuggauccgaacaaugaggaaggcgggcacggagucaaaggcugggcguucgacgaugggaacgacguguggaugggacgcaccaucagcgagaagucuagacucggcuaugagacauuuaaaguuauugaagggugguccaauccuaagagcaaacugcagaucaaccgccaggugauugucgaucggggaaauagaucuggcuacuccggcaucuucagcguggaggggaaguccuguauuaaccggugcuuuuaugucgaacugaucagaggacgcaaggaggaaaccgaggugcucuggaccucuaauagcauuguuguguucuguggcacauccgggaccuacggaacaggcucuuggcccgacggggccgauaucaaccugaugccugucuga

SEQ ID NO: 204680 - RNA, 1410 nt, Artificial Sequence; identical to SEQ ID NO: 204679
  derived and/or modified sequence opt5 from neuraminidase__InfluenzaA__AEY69953

SEQ ID NO: 204681 - RNA, 1410 nt, Artificial Sequence; identical to SEQ ID NO: 204679
  derived and/or modified sequence opt5 from neuraminidase__InfluenzaA__AEY69964

SEQ ID NO: 204682 - RNA, 1410 nt, Artificial Sequence; identical to SEQ ID NO: 204659
  derived and/or modified sequence opt5 from neuraminidase__InfluenzaA__AEY69975

SEQ ID NO: 204683 - RNA, 1410 nt, Artificial Sequence; identical to SEQ ID NO: 204659
  derived and/or modified sequence opt5 from neuraminidase__InfluenzaA__AEY69986

SEQ ID NO: 204684 - RNA, 1410 nt, Artificial Sequence; identical to SEQ ID NO: 204659
  derived and/or modified sequence opt5 from neuraminidase__InfluenzaA__AEY69997

SEQ ID NO: 204685 - RNA, 1410 nt, Artificial Sequence; identical to SEQ ID NO: 204659
  derived and/or modified sequence opt5 from neuraminidase__InfluenzaA__AEY70008

SEQ ID NO: 204686 - RNA, 1410 nt, Artificial Sequence; identical to SEQ ID NO: 204659
  derived and/or modified sequence opt5 from neuraminidase__InfluenzaA__AEY70019

SEQ ID NO: 204687 - RNA, 1410 nt, Artificial Sequence; identical to SEQ ID NO: 204659
  derived and/or modified sequence opt5 from neuraminidase__InfluenzaA__AEY70259

SEQ ID NO: 204688 - RNA, 1410 nt, Artificial Sequence; identical to SEQ ID NO: 204659
  derived and/or modified sequence opt5 from neuraminidase__InfluenzaA__AEY70270

SEQ ID NO: 204689 - RNA, 1410 nt, Artificial Sequence; identical to SEQ ID NO: 204659
  derived and/or modified sequence opt5 from neuraminidase__InfluenzaA__AEY70281

SEQ ID NO: 204690 - RNA, 1410 nt, Artificial Sequence; identical to SEQ ID NO: 199623
  derived and/or modified sequence opt5 from neuraminidase__InfluenzaA__AEY70303

SEQ ID NO: 204691 - RNA, 1410 nt, Artificial Sequence; identical to SEQ ID NO: 199623
  derived and/or modified sequence opt5 from neuraminidase__InfluenzaA__AEY70314

SEQ ID NO: 204692 - RNA, 1410 nt, Artificial Sequence
  derived and/or modified sequence opt5 from neuraminidase__InfluenzaA__AEY70325
augaaccccaaucagaagaucauuaccaucggcagcgugucccugacaauuucuacgaucugcuucuuuaugcaaauugccauccucaugaccacagucacccugcacuucaaacaguacgaguuuaacccuccgcccaauaaccagguuaugcuuugugaaccuacaaucauugagagaaauaucaccgaaauuguguaucugacaaacaccacgaucgagaaggaaauuugccccaaacucgcugaguaccggaauuggagcaagccucagugugacaucaccggguucgcccccuuuuccaaagauaacucuauucgccugagcgcgggaggcgacaucugggugacaagagagccuuaugucuccugcgauccggacaaguguuaccaauucgcucuugggcagggaaccacacugaauaacgugcauucuaauaacaccguucgggaucgcacgcccuauagaacacuccugaugaaugaacugggcgugccuuuucaccucgggaccaagcaggucugcaucgccuggagcuccagcucuugucaugacggaaaagccuggcugcacgugugcauuacaggcgaugacaagaacgcuaccgccuccuucaucuacaauggccggcuuguugauagcguggucucuugguccaaagagauucugcgcacccaggaaagcgagugugugugcaucaacgggacauguacgguggucaugaccgacggaucugcuuccggcaaggccgauacaaaaauucucuuuaucgaggaagggaagaucguucauaccagcacacuguccggaucugcgcaacacguggaggaaugcagcugcuaucccagauacccuggcgugcggugugucugccgcgacaacuggaagggguccaauagacccauuguggauaucaacauuaaagaccacagcaucguuucuuccuacguguguagcggacuugucggcgacaccccgcggaagaaugauucuagcuccucuagccauugccuggacccuaacaaugaggaaggcgggcacggagugaaaggcugggccuucgaugacgggaacgauguuuggaugggacgcacgauuuccgaaaagagcagacucggcuaugagacauuuaaagugaucgagggguggucuaaucccaaguccaaacugcagaucaaccggcaggucauuguggaccgcggaaauagaagcggcuacucuggcaucuucuccgucgagggaaagagcuguauuaaccggugcuuuuauguggaacugaucagagggcgcaaggaggaaaccgagguucucuggaccuccaauucuauuguggucuucuguggcacaagcgggaccuacggaacaggcuccuggccugauggggcugacaucaaccugaugcccguguga

SEQ ID NO: 204693 - RNA, 1410 nt, Artificial Sequence
  derived and/or modified sequence opt5 from neuraminidase__InfluenzaA__AEY70336
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcgguguaucugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccggggaaauagaucuggcuacuccggcaucuucagcguggaggauaaguccuguauuaaccggugcuuuuaugucgaacugaucagagggcgcaaggaggaaaccgaggugcucuggaccucuaauagcauuguuguguucuguggaacauccggcaccuacgggacaggaucuuggcccgacggcgcugauaucaaccugaugccugucuga

SEQ ID NO: 204694 - RNA, 1410 nt, Artificial Sequence; identical to SEQ ID NO: 199762
  derived and/or modified sequence opt5 from neuraminidase__InfluenzaA__AEY70358

SEQ ID NO: 204695 - RNA, 1410 nt, Artificial Sequence; identical to SEQ ID NO: 199623
  derived and/or modified sequence opt5 from neuraminidase__InfluenzaA__AEY70379

SEQ ID NO: 204696 - RNA, 1410 nt, Artificial Sequence; identical to SEQ ID NO: 201385
  derived and/or modified sequence opt5 from neuraminidase__InfluenzaA__AFB70139

SEQ ID NO: 204697 - RNA, 1410 nt, Artificial Sequence; identical to SEQ ID NO: 199762
  derived and/or modified sequence opt5 from neuraminidase__InfluenzaA__AFB70141

SEQ ID NO: 204698 - RNA, 1410 nt, Artificial Sequence; identical to SEQ ID NO: 201385
  derived and/or modified sequence opt5 from neuraminidase__InfluenzaA__AFB70147

SEQ ID NO: 204699 - RNA, 1410 nt, Artificial Sequence; identical to SEQ ID NO: 199762
  derived and/or modified sequence opt5 from neuraminidase__InfluenzaA__AFB70153

SEQ ID NO: 204700 - RNA, 1410 nt, Artificial Sequence; identical to SEQ ID NO: 199762
  derived and/or modified sequence opt5 from neuraminidase__InfluenzaA__AFB70155

SEQ ID NO: 204701 - RNA, 1410 nt, Artificial Sequence; identical to SEQ ID NO: 200732
  derived and/or modified sequence opt5 from neuraminidase__InfluenzaA__AFB70157

SEQ ID NO: 204702 - RNA, 1410 nt, Artificial Sequence; identical to SEQ ID NO: 199762
  derived and/or modified sequence opt5 from neuraminidase__InfluenzaA__AFB70159

SEQ ID NO: 204703 - RNA, 1410 nt, Artificial Sequence
  derived and/or modified sequence opt5 from neuraminidase__InfluenzaA__AFB70161
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcacaaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcugguauuggcccgauggggcugagcugccuuucacaauugacaaguga

SEQ ID NO: 204704 - RNA, 1410 nt, Artificial Sequence
  derived and/or modified sequence opt5 from neuraminidase__InfluenzaA__AFB70163
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacgcuaucuggacguccgggagcucuauuuccuuuuguggaguuaauagcgacaccgugggcuggucuuggcccgauggggccgagcugccuuucacaaucgacaaguga

SEQ ID NO: 204705 - RNA, 1410 nt, Artificial Sequence
  derived and/or modified sequence opt5 from neuraminidase__InfluenzaA__AFB70169
augaaccccaaucagaagaucauuaccaucggcagcgugugcaugacaauugggauggccaaccugauccuccaaauuggaaauaucaucuccauuuggaucaaccacucuauucagcugggcaaucagaaccagaucgagacguguaaucaaagcgucauuaccuacgaaaacaauacauggguuaaccagaccuaugugaauaucuccaacacaaauuucgcugccgggcagucuguggucagcgugaaacuugcgggaaacuccucucugugcccuguuagcggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 204706 - RNA, 1410 nt, Artificial Sequence; identical to SEQ ID NO: 199762
  derived and/or modified sequence opt5 from neuraminidase__InfluenzaA__AFB70199

SEQ ID NO: 204707 - RNA, 1410 nt, Artificial Sequence; identical to SEQ ID NO: 199762
  derived and/or modified sequence opt5 from neuraminidase__InfluenzaA__AFB70209

SEQ ID NO: 204708 - RNA, 1410 nt, Artificial Sequence; identical to SEQ ID NO: 199762
  derived and/or modified sequence opt5 from neuraminidase__InfluenzaA__AFB70219

SEQ ID NO: 204709 - RNA, 1410 nt, Artificial Sequence; identical to SEQ ID NO: 199762
  derived and/or modified sequence opt5 from neuraminidase__InfluenzaA__AFB70229

SEQ ID NO: 204710 - RNA, 1410 nt, Artificial Sequence; identical to SEQ ID NO: 199762
  derived and/or modified sequence opt5 from neuraminidase__InfluenzaA__AFB70239

SEQ ID NO: 204711 - RNA, 1410 nt, Artificial Sequence; identical to SEQ ID NO: 199762
  derived and/or modified sequence opt5 from neuraminidase__InfluenzaA__AFB70249

SEQ ID NO: 204712 - RNA, 1410 nt, Artificial Sequence; identical to SEQ ID NO: 199762
  derived and/or modified sequence opt5 from neuraminidase__InfluenzaA__AFB70259

SEQ ID NO: 204713 - RNA, 1410 nt, Artificial Sequence; identical to SEQ ID NO: 200732
  derived and/or modified sequence opt5 from neuraminidase__InfluenzaA__AFB70269

SEQ ID NO: 204714 - RNA, 1410 nt, Artificial Sequence; identical to SEQ ID NO: 199762
  derived and/or modified sequence opt5 from neuraminidase__InfluenzaA__AFB70279

SEQ ID NO: 204715 - RNA, 1410 nt, Artificial Sequence; identical to SEQ ID NO: 199762
  derived and/or modified sequence opt5 from neuraminidase__InfluenzaA__AFB70289

SEQ ID NO: 204716 - RNA, 1410 nt, Artificial Sequence; identical to SEQ ID NO: 199762
  derived and/or modified sequence opt5 from neuraminidase__InfluenzaA__AFB70299

SEQ ID NO: 204717 - RNA, 1410 nt, Artificial Sequence; identical to SEQ ID NO: 199762
  derived and/or modified sequence opt5 from neuraminidase__InfluenzaA__AFB70309

SEQ ID NO: 204718 - RNA, 1410 nt, Artificial Sequence; identical to SEQ ID NO: 201385
  derived and/or modified sequence opt5 from neuraminidase__InfluenzaA__AFB70319

SEQ ID NO: 204719 - RNA, 1410 nt, Artificial Sequence; identical to SEQ ID NO: 199762
  derived and/or modified sequence opt5 from neuraminidase__InfluenzaA__AFB70329

SEQ ID NO: 204720 - RNA, 1410 nt, Artificial Sequence; identical to SEQ ID NO: 199762
  derived and/or modified sequence opt5 from neuraminidase__InfluenzaA__AFB70349

SEQ ID NO: 204721 - RNA, 1410 nt, Artificial Sequence; identical to SEQ ID NO: 199762
  derived and/or modified sequence opt5 from neuraminidase__InfluenzaA__AFB70359

SEQ ID NO: 204722 - RNA, 1410 nt, Artificial Sequence; identical to SEQ ID NO: 199762
  derived and/or modified sequence opt5 from neuraminidase__InfluenzaA__AFB70369

SEQ ID NO: 204723 - RNA, 1410 nt, Artificial Sequence; identical to SEQ ID NO: 199762
  derived and/or modified sequence opt5 from neuraminidase__InfluenzaA__AFB70379

SEQ ID NO: 204724 - RNA, 1410 nt, Artificial Sequence; identical to SEQ ID NO: 199762
  derived and/or modified sequence opt5 from neuraminidase__InfluenzaA__AFB70389

SEQ ID NO: 204725 - RNA, 1410 nt, Artificial Sequence; identical to SEQ ID NO: 199762
  derived and/or modified sequence opt5 from neuraminidase__InfluenzaA__AFB70399

SEQ ID NO: 204726 - RNA, 1410 nt, Artificial Sequence; identical to SEQ ID NO: 199762
  derived and/or modified sequence opt5 from neuraminidase__InfluenzaA__AFB70409

SEQ ID NO: 204727 - RNA, 1410 nt, Artificial Sequence
  derived and/or modified sequence opt5 from neuraminidase__InfluenzaA__AFB77614
augcaccccaaccaggaggugaucagcauugucuccguuugcaugaccaucggcauggccaaucugauucuccaaaucgggaacauuaucucuaucuggauuagccauuccauccagcugggaaaucagaaccagauugaaacauguaaucaaucugugaucacguacgagaacaauaccugggugaaccagacauaugucaauauuagcaacaccaauuucgcugccggccaguccgugguuucugugaaacuugcggggaacagcucccugugcccugucagcggaugggcuaucuacucuaaggacaauuccauuagaaucggcagcaagggggauguguuuguuauccgggaaccguucauuucuuguucuccccucgagugccgcacauuuuuccugacccagggagcccuucugaacgacaaacacagcaauggcacaaucaaggauagaucuccuuaucggacccucauguccugucccauuggcgaagugccuagccccuacaacucccgcuuugagucugucgccuggagcgcuuccgccugccaugacgggaucaacuggcugacgauuggaaucagcggcccugauaauggggcuguggccgugcugaaauauaacggaaucauuaccgacacaaucaagucuuggagaaauaacauucuccggacccaagaguccgaaugugcgugcgucaauggcagcuguuucacaaucaugaccgaugggccgucugacggacaggccagcuacaagauuuuucgcaucgagaaaggcaagaucguuaaauccguggaaaugaacgcucccaauuaucacuacgaggagugcucuuguuacccugauagcuccgaaauuacgugcgugugcagagacaacuggcauggcagcaaucggcccugggucucuuucaaccagaaucuggaguaucagaucggguacauuuguuccggaaucuuuggcgauaacccucgccccaaugacaagacagggagcugcggaccggugucuuccaacggcgccaaugggguuaaaggauucagcuuuaaguauggcaacggcguguggauugggagaaccaaguccaucucuagccggaaaggauucgaaaugauuugggauccuaacggcuggacagggaccgacaauaacuuuuccaucaagcaagacaucgucggaauuaaugaguggucuggcuacagcggguccuucgugcagcaccccgaacuuaccggccuggauuguauccgcccuugcuucuggguugagcucauuagaggacggcccaaagagaacacaaucuggacgagcggcuccuccauuagcuuuuguggggucaauucugacaccgugggaugguucuggcccgauggcgcugaacugccuuuuacaaucgacaaguga

SEQ ID NO: 204728 - RNA, 1410 nt, Artificial Sequence
  derived and/or modified sequence opt5 from neuraminidase__InfluenzaA__AFB77615
augcaccccaaccaggagaucauuaccuucgugagcgucugcaugacaaucggcauggccaaucugauucuccaaaucgggaacauuaucuccaucuggauuucucauagcauccagcugggaaaucagaaccagauugaaacguguaaucaauccguuaucaccuacgagaacaauacaugggugaaccagaccuaugugaauauuucuaacacaaauuuugcugccggccagagcgucguguccguuaaacuugcggggaacucuagccugugcccuguguccggaugggcuaucuacagcaaggacaauucuauuagaaucggcuccaagggggaugucuucgugauccgggaaccguuuauuagcuguucuccccucgagugccgcaccuucuuucugacacagggagcccuucugaacgacaaacacuccaauggcaccaucaaggauagaagcccuuaucggacgcucaugucuugucccauuggcgaaguuccuucccccuacaacagccgcuucgaguccguggccuggucugcuagcgccugccaugacgggaucaacuggcugaccauuggaaucuccggcccugauaauggggcugucgccgugcugaaauauaacggaaucauuacagacaccaucaagagcuggagaaauaacauucuccggacacaagagucugaaugugcgugcgugaauggcuccuguuuuaccaucaugacggaugggccgagcgacggacaggccucuuacaagauuuuccgcaucgagaaaggcaagaucgucaaaagcguugaaaugaacgcucccaauuaucacuacgaggagugcuccuguuacccugauucuagcgaaauuacaugcgugugcagagacaacuggcauggcuccaaucggcccugggugagcuuuaaccagaaucuggaguaucagaucggguacauuuguucuggaaucuucggcgauaacccucgccccaaugacaagaccggguccugcggaccggucagcucuaacggcgccaauggggugaaaggauuuuccuucaaguauggcaacggcguuuggauugggagaacaaagagcaucuccucucggaaaggauuugaaaugauuugggauccuaacggcuggaccgggaccgacaauaacuucagcaucaagcaagacaucgugggaauuaaugagugguccggcuacucugggagcuucguccagcaccccgaacuuacaggccuggauuguauccgcccuugcuuuuggguggagcucauuagaggacggcccaaagagaacacgaucuggaccuccggcagcucuauuuccuucugugggguuaauagcgacacagugggauggucuuggcccgauggcgcugaacugccuuuuaccaucgacaaguga

SEQ ID NO: 204729 - RNA, 1410 nt, Artificial Sequence
  derived and/or modified sequence opt5 from neuraminidase__InfluenzaA__AFB78128
augaaccccaaucagaagaucauuaccaucggcagcgugucccugacaauugccacgaucugcuuccucaugcaaauugucauccugguuaccacagugacccuucacuuuaaacagcaugaguguaacucuccuccgaauaaccaggugaugcugugcgaacccacaaucauugagagaaauaucaccgaaauugucuaccucacaaacaccacgaucgagaaggaaauuuguccuaaacuggcugaguaucggaauuggagcaagccccagugcaaaaucaccggguucgccccuuuuuccaaggacaacucuauucgccuuagcgcgggaggcgauaucugggugacaagagagcccuacguuuccugugacccugauaagugcuaucaauucgcucuggggcagggaaccacacucaauaaccggcacucuaaugacaccgugcaugaucgcacgccguacagaacacugcugaugaacgaacucggcguccccuuucaccuggggaccaaacagguguguaucgccuggagcuccagcucuugccaugacggaaaggccuggcuucacguuugugugacaggccacgaugagaaugcuaccgccuccuucauuuaugacggccggcuggucgauagcaucgggucuugguccaaaaagauucuccgcacccaggaaagcgagugcguguguaucaacggaacaugcacgguggucaugaccgacggcucugcuuccgggagagccgauacaaaaauucuguuuaucgaggaaggaaagaucguucauaccagcaaacuuuccggcucugcgcaacacguggaggaaugcagcuguuacccucgguaucccggggugcgcugcgucuguagagacaauuggaagggauccaaccggccuauuguggauaucaacguuaaggacuacagcauugugucuuccuacgucugcagcggccuggugggcgacacaccccgcaaaaaugauucuagcuccucuagccauugucucgacccgaacaaugaggaagggggacacggcguuaaggggugggccuucgaugacggaaacgauguguggaugggcagaaccaucuccgagaaaagccggucuggguaugagacguuuaaggucauugaaggaugguccaaaccuaauagcaagcugcagaucaaccgccaggugaucgucgagagaggcaauaugucuggcuacuccgggauuuucagcguggaaggaaaguccugcaucaaccgguguuuuuauguugagcugauuagaggccgcaaacaggaaacagaggugugguggaccucuaauagcaucgucguguucugcgggaccuccggaacauacggcaccgggucuuggcccgacggcgcugauauuaaccucaugccuaucuga

SEQ ID NO: 204730 - RNA, 1410 nt, Artificial Sequence
  derived and/or modified sequence opt5 from neuraminidase__InfluenzaA__AFC62078
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggaacucuucaucucuuguuccccgcuggagugccgcaccuuuuuccuuacacagggcgcccugcucaacgacaagcauagcaauggcaccauuaaagauagaucucccuaucggacgcugauguccuguccuaucggggaggugcccagcccuuacaacucccgcuuugaaucuguugccuggagcgcuuccgccugccacgacggaauuaacuggcugaccaucggcaucagcgggcccgauaauggagcuguggccguccucaaguauaacggcauuaucacagacaccauuaagucuuggagaaaugauauccugcggacacaagaguccgagugugcgugcgugaacgggagcuguuucaccauuaugacggacggaccuucugauggccaggccagcuacaaaaucuuucgcaucgaaaagggcaaaauugugaaguccgucgagaugaaugcuccgaacuaucauuacgaagagugcucuuguuaccccgacagcuccgagaucacaugcguuugcagagauaauuggcacgggagcaaccggccuugggugucuuucaaucagaaccuugaauaucagauuggauacaucuguuccggcauuuuuggggacaauccccgcccuaacgauaaaaccggaagcugcggccccgugucuuccaauggggccaacggagucaagggcuucagcuuuaaguauggcaaugggguguggaucggaagaacaaaauccauuucuagccggaagggcuucgagaugaucugggacccgaacggguggaccggaaccgacaacaauuuuuccaucaaacaagauauuguuggcaucaacgaauggucuggguacagcggcuccuucgugcagcauccugagcugacaggaauggacuguauucgccccugcuucugggucgaacucaucagaggccggccuaaggagaauacgauuuggaccagcgggucuuccaucagcuuuuguggagugaacucugauacaguuggcugguccuggcccgacggggcugagcugcccuucaccaucgauaaauga

SEQ ID NO: 204731 - RNA, 1410 nt, Artificial Sequence
  derived and/or modified sequence opt5 from neuraminidase__InfluenzaA__AFC62079
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucauuaagagcgucgagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauucuuggggauaauccucgccccaacgacaaaaccggauccugcggcccggugagcucuaauggggccaacggagucaagggcuuuuccuucaaguauggcaacgggguguggguuggaagaacaaaaagcaucuccucucggaauggcuuugagaugauuugggauccuaacggguggaccggaaccgacaauaacuucagcaucaagcaagacaucgugggcauuaaagaaugguccggguacucuggcagcuuuguccagcaucccgagcugacaggacucgauuguauccgcccuugcuucuggguggaacugauuagaggccggcccaaggagaauacgaucuggaccuccgggagcauuaucucuuucuguggaguuaacuccgacacagugggcuggagcuggcccgauggggcugagcuuccuuuuaccaucgacaaauga

SEQ ID NO: 204732 - RNA, 1410 nt, Artificial Sequence
  derived and/or modified sequence opt5 from neuraminidase__InfluenzaA__AFC62080
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuauuacuacgaagagugcucuuguuauccugauagcuccgagaucacaugcguuugcagagacaacuggcaugggagcaaucggcccugggugucuuucaaccagaaucuggaauaccagauuggauauaucuguuccggcauuuuuggggauaacccucgccccaaugacaaaaccggaagcugcggcccggugucuuccaacggggccaauggagucaagggcuucagcuuuaaguacggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguauagcggcuccuucgugcagcaccccgagcuuacaggaaugggcuguauucgcccuugcuucugggucgaacugaucagagggcggcccaaggagaacacgauuuggaccagcggaucuuccaucagcuuuuguggcguuaauucugauacaguggggugguccuggcccgacggagcugagcucccuuucaccaucgauaaauga

SEQ ID NO: 204733 - RNA, 1410 nt, Artificial Sequence
  derived and/or modified sequence opt5 from neuraminidase__InfluenzaA__AFC62082
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucggggccgcacgccguauagaacacuccugaugaacgaacugggggugcccuuucaccucggaaccaagcaggucugcauugccugguccucuagcuccugucaugacggcaaagccuggcugcacgugugcaucacaggcgaugacaagaaugcuaccgccagcuucauuuacaacgggcggcuuguugauucuguggucuccuggagcaaagagauccugcgcacccaggaaucugagugugugugcauuaacggaacauguacgguggucaugaccgacggcuccgcuagcgggaaggccgauacaaaaauccucuuuaucgaggaaggaaagauuguucauaccuccacacugucuggcagcgcgcaacacguggaggaaugcuccugcuauccuagauaccccggggugcggugugucugccgcgacaauuggaagggaagcaacagaccuaucguggauauuaauaugaaagaccacucuaucguuuccagcuacguguguucuggccuugucggcgauacgccccggaagaacgacagcuccucuagcucccauugcuucgacccgaaugaugaggaagggggacacggcgugaaagggugggccuuugacgauggaaacgacguuuggaugggccgcaccauuagcgagaagucuagacugggguaugagacauucaaagugaucgaaggaugguccaauccuaagagcaaacuccagaucaaccggcaggucauuguggaucgcggcgacagaucuggcuacuccgggaucuuuagcgucgagggaaaguccuguauuaaucggugcuucuauguggaacugaucagaggcucuaaggaggaaaccgagguucuguggaccagcaacuccauuguggucuucugugggacaucuggaaccuacggcacagggagcuggcccgauggcgcugacaucaaucucaugccuauuuga

SEQ ID NO: 204734 - RNA, 1410 nt, Artificial Sequence; identical to SEQ ID NO: 197249
  derived and/or modified sequence opt5 from neuraminidase__InfluenzaA__AFD63529

SEQ ID NO: 204735 - RNA, 1410 nt, Artificial Sequence; identical to SEQ ID NO: 197249
  derived and/or modified sequence opt5 from neuraminidase__InfluenzaA__AFD63540

SEQ ID NO: 204736 - RNA, 1410 nt, Artificial Sequence
  derived and/or modified sequence opt5 from neuraminidase__InfluenzaA__AFD63551
augaaccccaaucagaagaucauuaccaucggcagcgugucccugacaauugccgcuaucugcuuccucaugcaaauugccauccuggucacgaccguuacacuucacuuuaaacagcaugaguguaacccuccgcccaauaaccaggugaugcugugcgaaccuaccaucauugagagaaauaucacagaaauuguguaccucaccaacacaaccaucgagaaggaaauuugucccaaacuggcggaguaucggaauuggucuaagccucagugcaacaucacgggguucgcucccuuuagcaaagacaauuccauucgccuuucugccggaggcgauaucugggucaccagagagccuuacgugagcugugacccggauaagugcuaucaauucgcccuggggcagggaacaacccucaacaauggccacuccaacgacacaguucaugggcggacccccuaccgcacgcugcugaugaaugaacucggagugccuuuucaccugggcacaagacaggucuguaucgcuuggucuagcuccagcugccaugauggcaaggccuggcuucacguguguguuaccggggacgauaaaaacgcuacagccucuuucauuuauaauggacggcugguggacuccaucggcagcuggucuaagaaaauucuccgcacccaggaguccgaaugcgucuguaucaacgggaccugcacaguggugaugacggauggaagcgcgucuggcaaggccgacaccaaaauucuguuuaucgaggaggggaagaucguccacauuuccacacuuagcggauccgcucaacauguugaagagugcucuuguuaccccagauauccuggcgugcggugcgugugucgcgauaacuggaagggcagcaauagacccaucgucgacauuaacgugaaagauuacuccaucguuagcucuuacgugugcuccgggcuggucggagacaccccgcggaagaaugacagcuucucuagcucccacugucucgauccuaacaaugaagagggcgggcauggagugaaaggcugggccuuugacgaugggaacgacguuuggaugggacgcacaauuucugaaaagcugagaagcggcuaugagaccuucaaagugaucgagggcugguccaagcccaauagcaaacugcagaucaaccggcaggucauuguggaacgcgggaauagaucuggauacuccggcaucuuuagcgucgaggggaagucuugcauuaaccgguguuucuauguggaacucaucagaggacgcaaggaggaaacggagguuugguggacauccaauagcauuguggucuuuugcggcaccuccgggaccuacggcacaggaucuuggccugauggcgcugacaucaaccugaugcccauuuga

SEQ ID NO: 204737 - RNA, 1410 nt, Artificial Sequence; identical to SEQ ID NO: 197249
  derived and/or modified sequence opt5 from neuraminidase__InfluenzaA__AFD63562

SEQ ID NO: 204738 - RNA, 1410 nt, Artificial Sequence
  derived and/or modified sequence opt5 from neuraminidase__InfluenzaA__AFD63573
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugggagaaauaucaccgagauuguguaccucacaaacaccacgaucgaaaaggagauuuguccuaaacuggccgaauaucggaauuggagcaagccccagugcaacaucaccggauucgcgccuuuuuccaaagacaauucuauucgccuuagcgcuggcggggauaucugggucacaagagagcccuacguguccugugacccugauaagugcuaucaauucgcccugggacagggcaccacacucaacaaugggcacucuaacgacaccguucaugaucggacgccguaccgcacacugcugaugaaugagcucggagugcccuuucaccugggcaccagacaggucuguaucgccuggagcuccagcucuugccaugacggcaaggcuuggcuucacguguguguuacaggggaugacaaaaacgccaccgcuuccuucauuuauaauggacggcugguggauagcaucggcucuugguccaagaaaauucuccgcacccaggaaagcgagugcgucuguaucaacgggacaugcacgguggugaugaccgacggaucugccuccggcaaggcggauacaaaaauucuguuuaucgaagaggggaagaucguccacauuagcacccuuuccggaucugcccaacauguugaggaaugcagcuguuacccuagauaucccggcgugcggugcgugugucgcgacaacuggaagggcuccaauagaccuaucgucgauauuaacgugaaagacuacagcaucguuucuuccuacgugugcagcgggcuggucggagacacaccccggaagaaugauucuuucagcuccucucacugucucgacccgaacaaugaggaaggcgggcauggagugaaaggcugggcuuuugaugacgggaacgauguuuggaugggacgcaccauuagcgagaagcugagauccggcuaugaaacguucaaagugaucgagggcuggagcaagccuaauucuaaacugcagaucaaccggcaggucauuguggagcgcgggaauagauccggauacagcggcaucuuuucugucgaagggaaguccugcauuaaccgguguuucuauguggagcucaucagaggacgcaaggaagagacagaaguuugguggaccagcaauuccauuguggucuuuugcggcaccucugggacauacggcaccggaagcuggcccgacggcgccgauaucaaccugaugccuauuuga

SEQ ID NO: 204739 - RNA, 1410 nt, Artificial Sequence
  derived and/or modified sequence opt5 from neuraminidase__InfluenzaA__AFD63584
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaacggacgccguaucgcacacugcugaugaaugagcucggggugcccuuucaucugggaaccagacaggucuguaucgccuggagcuccagcucuugccacgauggcaaggcuuggcuucauguguguguuacaggcgacgauaaaaacgccaccgcuuccuucauuuacaaugggcggcugguggacagcaucggaucuugguccaagaaaauucuccgcacccaggaaagcgagugcgucuguaucaacggcacaugcacgguggugaugaccgaugggucugccuccggaaaggcggacacaaaaauucuguuuaucgaggaaggcaagaucauucacaucagcacccuuuccgggucugcccaacacgucgaggaaugcagcuguuauccuagauaccccggaguucggugcgugugucgcgauaacuggaagggcuccaauagaccuauuguggacaucaacgucaaagauuacagcauugugucuuccuauguuugcagcggccuggugggggacacaccccggaagaaugacucuagcuccucuagccauugucucgauccgaacaaugaggaaggaggccacggggucaaaggaugggcuuucgacgauggcaacgacguguggauggggcgcaccaucuccgagaagcugagaagcggauacgagacguuuaaaguuaucgaaggcuggucuaagccuaauuccaaacugcagauuaaccgccaggugaucgucgagcggggcaauagaagcggguauucuggaauuuucuccguggaaggcaagagcugcaucaaccgguguuuuuacgucgagcucauuagagggcgcaaggaagagacagaggugugguggaccuccaauucuaucguuguguucugcggaaccagcggcacauaugggaccggcuccuggcccgauggagccgacauuaaccugaugccuaucuga

SEQ ID NO: 204740 - RNA, 1410 nt, Artificial Sequence
  derived and/or modified sequence opt5 from neuraminidase__InfluenzaA__AFD63595
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcguguguaaggacaacuggaaaggcuccaaucgcccuaucgucgauauuaacgugaaggacuacagcaucguuucuuccuacgugugcagcggccuggucggggacacccccagaaagaaugauucuuucagcuccucucacugucucgacccgaacaaugaagagggaggccauggggugaaaggaugggccuuugaugacggcaacgauguuuggauggggcggacaauuagcgaaaaacugcgcuccggauaugagaccuucaaggugaucgagggcuggagcaaaccuaauucuaagcugcagaucaacagacaggucauuguggaacggggcaaucgcuccggguacagcggaaucuuuucugucgagggcaaguccugcauuaacagauguuucuauguggaacucauccgggggagaaaagaggaaacggagguuugguggacaagcaauuccauuguggucuuuugcggaaccucuggcaccuacgggacaggcagcuggcccgacggagcugauaucaaccugaugccuauuuga

SEQ ID NO: 204741 - RNA, 1410 nt, Artificial Sequence; identical to SEQ ID NO: 197249
  derived and/or modified sequence opt5 from neuraminidase__InfluenzaA__AFD63606

SEQ ID NO: 204742 - RNA, 1410 nt, Artificial Sequence; identical to SEQ ID NO: 197169
  derived and/or modified sequence opt5 from neuraminidase__InfluenzaA__AFD63628

SEQ ID NO: 204743 - RNA, 1410 nt, Artificial Sequence; identical to SEQ ID NO: 197249
  derived and/or modified sequence opt5 from neuraminidase__InfluenzaA__AFD63639

SEQ ID NO: 204744 - RNA, 1410 nt, Artificial Sequence; identical to SEQ ID NO: 197249
  derived and/or modified sequence opt5 from neuraminidase__InfluenzaA__AFD63650

SEQ ID NO: 204745 - RNA, 1410 nt, Artificial Sequence
  derived and/or modified sequence opt5 from neuraminidase__InfluenzaA__AFD63661
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacagcacaaucgagaaggaaauuuguccuaaacuggcggaguaucggaauugguccaagccccagugcaacaucaccggguucgcuccuuuuucuaaagacaauagcauucgccuuuccgccggaggcgauaucugggucacgagagagcccuacgugucuugugacccugauaagugcuaucaauucgcccuggggcagggaaccacacucaacaauggccacagcaacgacaccguucaugaucggacaccguaccgcacccugcugaugaaugaacucggggugcccuuucaccugggaacgagacaggucuguaucgcuugguccucuagcuccugccaugacggcaaggccuggcuucacguguguguuacaggcgaugacaaaaacgcuaccgccagcuucauuuauaaugggcggcugguggauucuaucggauccuggagcaagaaaauucuccgcacacaggagucugaaugcgucuguaucaacgggaccugcaccguggugaugacagacggcuccgcgagcggaaaggccgauacgaaaauucuguuuaucgaggagggcaagaucguccacauuuccacccuuucugggagcgcucaacauguugaagagugcuccuguuacccuagauaucccggagugcggugcgugugucgcgacaacuggaagggcagcaauagaccuaucgucgauauuaacgugaaagacuacucuaucguuuccagcuacgugugcucuggccuggucggggacacaccccggaagaaugauagcuucuccucuagccacugucucgacccgaacaaugaagagggaggccauggggugaaaggaugggccuuugaugacggcaacgauguuuggauggggcgcaccauuuccgaaaagcugagaagcggauaugagacauucaaagugaucgagggcuggucuaagccuaauuccaaacugcagaucaaccggcaggucauuguggaacgcggcaauagaagcggguacucuggaaucuuuuccgucgagggcaagagcugcauuaaccgguguuucuauguggaacucaucagagggcgcaaggaggaaaccgagguuugguggacguccaauucuauuguggucuuuugcggaacaagcggcaccuacgggaccggcuccuggcccgacggagcugauaucaaccugaugccuauuuga

SEQ ID NO: 204746 - RNA, 1410 nt, Artificial Sequence; identical to SEQ ID NO: 198955
  derived and/or modified sequence opt5 from neuraminidase__InfluenzaA__AFD63672

SEQ ID NO: 204747 - RNA, 1410 nt, Artificial Sequence
  derived and/or modified sequence opt5 from neuraminidase__InfluenzaA__AFD63683
augaaccccaaucagaagaucauuaccaugggcagcgugucccugacaaucgccacgauuugcuuccucaugcaaaucgcuauucuggucaccacaguuacccuucacuuuaaacaguacgaguguaacucuccuccgaauaaccaggugaugcugugcgaacccacaaucaucgagagaaauauuaccgaaaucguguaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggucacaagagagcccuauguguccugugacccugauaagugcuaccaauucgcccuggggcagggaaccacacucaacaauggccauucuaacgacaccguucacgggcggacgccguaucgcacacugcugaugaaugaacucggagugcccuuucaucugggcaccagacaggucuguaucgccuggagcuccagcucuugccacgauggcaaggcuuggcuucauguguguguuacaggggacgauaaaaacgccaccgcuuccuucaucuacaauggacggcugguggacagcauuggcucuugguccaagaaaauccuccgcacccaggagagcgaaugcgucuguauuaacgggacaugcacgguggugaugaccgauggaucugccuccggcaaggcggacacaaaaauccuguuuauugaggaggggaagaucauccacauuagcacccuuuccggaucugcccaacacgucgaagagugcagcuguuauccuagauaccccggcguucggugcgugugucgcgauaacuggaagggcuccaauagaccuaucguggacauuaacgucaaagauuacagcaucgugucuuccuauguuugcagcgggcuggugggagacacaccccggaagaaugacucuagcuccucuagccauugucucgauccgaacaaugaagagggcgggcacggagucaaaggcugggcuuucgacgaugggaacgacguguggaugggacgcaccauuuccgaaaagcugagaagcggcuacgagacguuuaaaguuaucgagggcuggucuaagccuaauuccaaacugcagaucaaccgccaggugauugucgaacgggggaauagaagcggauauucuggcaucuucuccguggagggaaagagcugcauuaaccgguguuuuuacgucgaacucaucagagggcgcaaggaggaaacagaggugugguggaccuccaauucuauuguuguguucugcggcaccagcgggacauauggcaccggauccuggcccgauggcgccgacaucaaccugaugccuauuuga

SEQ ID NO: 204748 - RNA, 1410 nt, Artificial Sequence
  derived and/or modified sequence opt5 from neuraminidase__InfluenzaA__AFD63694
augaaccccaaucagaagaucauuaccaucggcagcgugucccugacaauugccacgaucugcuuccucaugcaaauugcuauccuggucaccacaaucacccuucacuuuaaacagcaugaguguaacucuccuccgaauaaccagguuaugcugugcgaacccacaauuaucgagagaaauauuaccgaaaucguguaccucacaaacaccacgauugagaaggaaaucuguccuaaacuggccgaguaucggaauuggagcaagccccagugcaacauuaccggguucgcgccuuuuuccaaagacaauucuauccgccuuagcgcuggaggcgauaucugggugacaagagagcccuacgucuccugugacccugauaagugcuaucaauucgcccuggggcagggaaccacacucaacaauggccacucuaacgacaccgugcaugaucggacgccguaccgcacacugcugaugaaugaacucgggguucccuuucaccugggaaccagacagguguguauugccuggagcuccagcucuugccaugacggcaaggcuuggcuucacgucugugugacaggcgaugacaaaaacgccaccgcuuccuucaucuauaaugggcggcugguugauagcauuggaucuugguccaagaaaauccuccgcacccaggagagcgaaugcguguguauuaacggcacaugcacggucgugaugaccgacgggucugccuccggaaaggcggauacaaaaauccuguuuaucgaggagggcaagauugugcacaucagcacccuuuccgggucugcccaacaugucgaagagugcagcuguuacccuagauaucccggaguucggugcgugugucgcgacaacuggaagggcuccaauagaccuauuguggauaucaacgucaaagacuacagcauugugucuuccuacguuugcagcggccuggugggggacacaccccggaagaaugauucuuucagcuccucucacugucucgacccgaacaaugaagagggaggccauggggucaaaggaugggcuuuugaugacggcaacgauguguggauggggcgcaccaucagcgaaaagcugagauccggauaugagacguucaaaguuaucgagggcuggagcaagccuaauucuaaacugcagauuaaccgccaggugaucgucgaacggggcaauagauccggguacagcggaaucuuuucuguggagggcaaguccugcauuaaccgguguuucuaugucgaacucauuagagggcgcaaggaggaaacagaggugugguggaccagcaauuccaucguuguguuuugcggaaccucuggcacauacgggaccggcagcuggcccgacggagccgauauuaaccugaugccuaucuga

SEQ ID NO: 204749 - RNA, 1410 nt, Artificial Sequence
  derived and/or modified sequence opt5 from neuraminidase__InfluenzaA__AFD63705
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggaagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaagccuggcuucacguguguguuaccggcgaugacaagaacgcuacagccuccuucauuuauaaugggcggcugguggauagcaucggaucuugguccaaaaagauucuccgcacccaggagagcgaaugcgucuguaucaacgggaccugcacaguggugaugacggacggcucugcguccggaaaagccgauaccaagauucuguuuaucgaggagggcaagaucguccacauuagcacacuuuccgggucugcucagcauguugaagagugcagcuguuacccuagauaucccggagugcggugcgugugucgcgacaacuggaaaggcuccaauagaccuaucgucgauauuaacgugaaggacuacagcaucguuucuuccuacgugugcagcggccuggucggggacacaccccggaaaaaugauucuuucagcuccucucacugucucgacccgaacaaugaagagggaggccauggggugaagggaugggccuuugaugacggcaacgauguuuggauggggcgcaccauuagcgaaaaacugagauccggauaugagaccuucaaggugaucgagggcuggagcaaaccuaauucuaagcugcaaaucaaccggcaggucauuguggaacgcggcaauagauccggguacagcggaaucuuuucugucgagggcaaguccugcauuaaccgguguuucuauguggaacucaucagagggcgcaaagaggaaacggagguuugguggacaagcaauuccauuguggucuuuugcggaaccucuggcaccuacgggacaggcagcuggcccgacggagcugauaucaaccugaugccuauuuga

SEQ ID NO: 204750 - RNA, 1410 nt, Artificial Sequence
  derived and/or modified sequence opt5 from neuraminidase__InfluenzaA__AFD63716
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugccaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucacguguguguuaccggcgaugacaaaaacgcuacagccuccuucauuuacaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccauauuagcacacuuuccgggucugcucaacacguugaagagugcagcuguuauccuagauaccccggagugcggugcgugugucgcgacaacuggaagggcuccaauagaccuaucgucgauauuaacgugaaagacuauagcaucguuucuuccuacgugugcagcggccuggucggggacacaccccggaagaaugauucuuucagcuccucucauugucucgacccgaacaaugaagagggaggccacggggugaaaggaugggccuuugaugacggcaacgauguuuggauggggcgcaccauuagcgaaaagcugagauccggauacgagaccuucaaagugaucgagggcuggagcaagccuaauucuaaacugcagaucaaccggcaggucauuguggaacgcggcaauagauccggguauagcggaaucuuuucugucgagggcaaguccugcauuaaccgguguuucuacguggaacucaucagagggcgcaaggaggaaacggagguuugguggacaagcaauuccauuguggucuuuugcggaaccucuggcaccuaugggacaggcagcuggcccgacggagcugauaucaaccugaugccuauuuga

SEQ ID NO: 204751 - RNA, 1410 nt, Artificial Sequence; identical to SEQ ID NO: 197249
  derived and/or modified sequence opt5 from neuraminidase__InfluenzaA__AFD63727

SEQ ID NO: 204752 - RNA, 1410 nt, Artificial Sequence; identical to SEQ ID NO: 197249
  derived and/or modified sequence opt5 from neuraminidase__InfluenzaA__AFD63738

SEQ ID NO: 204753 - RNA, 1410 nt, Artificial Sequence
  derived and/or modified sequence opt5 from neuraminidase__InfluenzaA__AFD63749
augaaccccaaucagaagaucauuaccaucagcuccgugucucugacaauugccacgaucugcuuccucaugcaaauugcuauccuggucaccacaguuacccuucacuuuaaacagcaugaguguaacagcccuccgaauaaccaggugaugcugugcgaacccacaaucauugagagaaauaucaccgaaauuguguaccucacaaacaccacgaucgagaaggaaauuuguccuaaacuggccgaguaucggaauugguccaagccccagugcaacaucaccggcuucgcgccuuuuucuaaagacaauagcauucgccuuuccgcugggggagauaucugggucacaagagagcccuacgugucuugugacccugauaagugcuaucaauucgcccugggccaggggaccacacucaacaauggacacagcaacgacaccguucaugaucggacgccguaccgcacacugcugaugaaugaacucggcgugcccuuucaccuggggaccagacaggucuguaucgccugguccucuagcuccugccaugacggaaaggcuuggcuucacguguguguuacaggcgaugacaaaaacgccaccgcuagcuucauuuauaauggccggcugguggauucuaucggguccuggagcaagaaaauucuccgcacccaggagucugaaugcgucuguaucaacggaacaugcacgguggugaugaccgacggcuccgccagcgggaaggcggauacaaaaauucuguuuaucgaggagggaaagaucguccacauuuccacccuuucuggcagcgcccaacauguugaagagugcuccuguuacccuagauaucccggggugcggugcgugugucgcgacaacuggaagggaagcaauagaccuaucgucgauauuaacgugaaagacuacucuaucguuuccagcuacgugugcucuggccuggucggcgacacaccccggaagaaugauagcuucuccucuagccacugucucgacccgaacaaugaagaagggggacauggcgugaaagggugggcuuuugaugacggaaacgauguuuggaugggccgcaccauuuccgagaagcugagaagcggguaugagacguucaaagugaucgagggauggucuaagccuaauuccaaacugcagaucaaccggcaggucauuguggaacgcggcaauagaagcggcuacucugggaucuuuuccgucgagggaaagagcugcauuaaccgguguuucuauguggaacucaucagaggccgcaaggaggaaacagagguuugguggaccuccaauucuauuguggucuuuugcgggaccagcggaacauacggcaccggguccuggcccgacggcgccgauaucaaccugaugccuauuuga

SEQ ID NO: 204754 - RNA, 1410 nt, Artificial Sequence
  derived and/or modified sequence opt5 from neuraminidase__InfluenzaA__AFD63760
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacaaaaacgccaccgcuuccuucauuuacaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucauucacaucagcacccuuuccgggucugcccaacacgucgaagagugcagcuguuauccuagauaccccggaguucggugcgugugucgcgacaacuggaagggcuccaauagaccuauuguggauaucaacgucaaagacuacagcauugugucuuccuauguuugcagcggccuggugggggacacaccccggaagaaugauucuagcuccucuagccauugucucgacccgaacaaugaagagggaggccacggggucaaaggaugggcuuucgaugacggcaacgauguguggauggggcgcaccaucuccgaaaagcugagaagcggauacgagacguuuaaaguuaucgagggcuggucuaagccuaauuccaaacugcagauuaaccgccaggugaucgucgaacggggcaauagaagcggguauucuggaauuuucuccguggagggcaagagcugcaucaaccgguguuuuuacgucgaacucauuagagggcgcaaggaggaaacagaggugugguggaccuccaauucuaucguuguguucugcggaaccagcggcacauaugggaccggcuccuggcccgacggagccgauauuaaccugaugccuaucuga

SEQ ID NO: 204755 - RNA, 1410 nt, Artificial Sequence; identical to SEQ ID NO: 197249
  derived and/or modified sequence opt5 from neuraminidase__InfluenzaA__AFD63771

SEQ ID NO: 204756 - RNA, 1410 nt, Artificial Sequence; identical to SEQ ID NO: 197249
  derived and/or modified sequence opt5 from neuraminidase__InfluenzaA__AFD63782

SEQ ID NO: 204757 - RNA, 1410 nt, Artificial Sequence; identical to SEQ ID NO: 204754
  derived and/or modified sequence opt5 from neuraminidase__InfluenzaA__AFD63793

SEQ ID NO: 204758 - RNA, 1410 nt, Artificial Sequence; identical to SEQ ID NO: 197249
  derived and/or modified sequence opt5 from neuraminidase__InfluenzaA__AFD63804

SEQ ID NO: 204759 - RNA, 1410 nt, Artificial Sequence; identical to SEQ ID NO: 197249
  derived and/or modified sequence opt5 from neuraminidase__InfluenzaA__AFD63815

SEQ ID NO: 204760 - RNA, 1410 nt, Artificial Sequence; identical to SEQ ID NO: 197249
  derived and/or modified sequence opt5 from neuraminidase__InfluenzaA__AFD63826

SEQ ID NO: 204761 - RNA, 1410 nt, Artificial Sequence; identical to SEQ ID NO: 204754
  derived and/or modified sequence opt5 from neuraminidase__InfluenzaA__AFD63837

SEQ ID NO: 204762 - RNA, 1410 nt, Artificial Sequence
  derived and/or modified sequence opt5 from neuraminidase__InfluenzaA__AFD63848
augaaccccaaucagaagaucauuaccaucggcagcgugucccugacaauugccgcuaucugcuuccucaugcaaauugccauccuggucacgaccguuacacuucacuuuaaacagagagaguguaacucuccuccgaauaaccaggugaugcugugcgaacccaccaucauugagcggaauaucacagaaauuguguaccucaccaacacaaccaucgagaaggaaauuuguccuaaacuggcggaguaucgcaauuggagcaagccccagugcaacaucacgggguucgcuccuuuuuccaaagacaauucuauuagacuuagcgccggaggcgauaucugggucacccgggagcccuacguguccugugacccugauaagugcuaucaauucgcccuggggcagggaacaacccucaacaauggccauucuaacgacacaguucacgaucgcaccccguacagaacgcugcugaugaaugaacucggggugcccuuucaucugggaacacggcaggucuguaucgcuuggagcuccagcucuugccacgacggcaaggccuggcuucauguguguguuaccggcgaugacaaaaacgcuacagccuccuucauuuauaaugggcgccugguggauagcaucggaucuugguccaagaaaauucucagaacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacacguugaagagugcagcuguuacccucgguaucccggagugcgcugcguguguagagacaacuggaagggcuccaaucggccuaucgucgauauuaacgugaaagacuacagcaucguuucuuccuacgugugcagcggccuggucggggacacaccccgcaagaaugauucuuucagcuccucucauugucucgacccgaacaaugaagagggaggccacggggugaaaggaugggccuuugaugacggcaacgauguuuggauggggagaaccauuagcgaaaagcugcgguccggauaugagaccuucaaagugaucgagggcuggagcaagccuaauucuaaacugcagaucaaccgccaggucauuguggaaagaggcaaucgguccggguacagcggaaucuuuucugucgagggcaaguccugcauuaacagauguuucuauguggaacucauccgcgggcggaaggagaaaacggaaguuugguggacaagcaauuccauuguggucuuuugcggaaccucuggcaccuacgggacaggcagcuggcccgacggagcugauaucaaccugaugccuauuuga

SEQ ID NO: 204763 - RNA, 1410 nt, Artificial Sequence; identical to SEQ ID NO: 197169
  derived and/or modified sequence opt5 from neuraminidase__InfluenzaA__AFD63859

SEQ ID NO: 204764 - RNA, 1410 nt, Artificial Sequence; identical to SEQ ID NO: 197169
  derived and/or modified sequence opt5 from neuraminidase__InfluenzaA__AFD63870

SEQ ID NO: 204765 - RNA, 1410 nt, Artificial Sequence; identical to SEQ ID NO: 197249
  derived and/or modified sequence opt5 from neuraminidase__InfluenzaA__AFD63881

SEQ ID NO: 204766 - RNA, 1410 nt, Artificial Sequence; identical to SEQ ID NO: 197249
  derived and/or modified sequence opt5 from neuraminidase__InfluenzaA__AFD63892

SEQ ID NO: 204767 - RNA, 1410 nt, Artificial Sequence
  derived and/or modified sequence opt5 from neuraminidase__InfluenzaA__AFD63903
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagggauuguguaccucaccaacacaaccaucgaaaaggagauuuguccuaaacuggcggaauaucggaauuggagcaagccccagugcaacaucacgggauucgcuccuuuuuccaaagacaauucuauucgccuuagcgccggcggggauaucugggucaccagagagcccuacguguccugugacccugauaagugcuaucaauucgcccugggacagggcacaacccucaacaaugggcacucuaacgacacaguucaugaucggaccccguaccgcacgcugcugaugaaugagcucggagugcccuuucaccugggcacaagacaggucuguaucgcuuggagcuccagcucuugccaugacggcaaggccuggcuucacguguguguuaccggggaugacaaaaacgcuacagccuccuucauuuauaauggacggcugguggauagcaucggcucuugguccaagaaaauucuccgcacccaggaaagcgagugcgucuguaucaacgggaccugcacaguggugaugacggacggaucugcguccggcaaggccgauaccaaaauucuguuuaucgaagaggggaagaucguccacauuagcacacuuuccggaucugcucaacauguugaggaaugcagcuguuacccuagauaucccggcgugcggugcgugugucgcgacaacuggaagggcuccaauagaccuaucgucgauauuaacgugaaagacuacagcaucguuucuuccuacgugugcagcgggcuggucggagacacaccccggaagaaugauucuuucagcuccucucacugucucgacccgaacaaugaggaaggcgggcauggagugaaaggcugggccuuugaugacgggaacgauguuuggaugggacgcaccauuagcgagaagcugagauccggcuaugaaaccuucaaagugaucgagggcuggagcaagccuaauucuaaacugcagaucaaccggcaggucauuguggagcgcgggaauagauccggauacagcggcaucuuuucugucgaagggaaguccugcauuaaccgguguuucuauguggagcucaucagaggacgcaaggaagagacggaaguuugguggacaagcaauuccauuguggucuuuugcggcaccucugggaccuacggcacaggaagcuggcccgacggcgcugauaucaaccugaugccuauuuga

SEQ ID NO: 204768 - RNA, 1410 nt, Artificial Sequence
  derived and/or modified sequence opt5 from neuraminidase__InfluenzaA__AFD63914
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggagaaaacggaaguuugguggacaagcaauuccauuguggucuuuugcggaaccucuggcaccuacgggacaggcagcuggcccgacggagcugauaucaaccugaugccuauuuga

SEQ ID NO: 204769 - RNA, 1410 nt, Artificial Sequence; identical to SEQ ID NO: 204754
  derived and/or modified sequence opt5 from neuraminidase__InfluenzaA__AFD63925

SEQ ID NO: 204770 - RNA, 1410 nt, Artificial Sequence
  derived and/or modified sequence opt5 from neuraminidase__InfluenzaA__AFD63936
augaaccccaaucagaagaucauuaccaucggcagcgugucccugacaauugccacgaucugcuuccucaugcaaauugcuauccuggucaccacaguuacccuucacuuuaaacagcaugaguguaacccuccgcccaauaaccaggugaugcugugcgaaccuacaaucauugagagaaauaucaccgaaauuguguaccucacaaacaccacgaucgagaaggaaauuugucccaaacuggccgaguaucggaauuggucuaagccucagugcaacaucaccggguucgcgcccuuuagcaaagacaauuccauucgccuuucugcuggaggcgauaucugggucacaagagagccuuacgugagcugugacccggauaagugcuaucaauucgcccuggggcagggaaccacacucaacaauggccacuccaacgacaccguucaugaucggacgcccuaccgcacacugcugaugaaugaacucggggugccuuuucaccugggaaccagacaggucuguaucgccuggucuagcuccagcugccaugacggcaaggcuuggcuucacguguguguuacaggcgaugacaaaaacgccaccgcuucuuucauuuauaaugggcggcugguggauuccaucggaagcuggucuaagaaaauucuccgcacccaggaguccgaaugcgucuguaucaacggcacaugcacgguggugaugaccgacgggagcgccucuggaaaggcggauacaaaaauucuguuuaucgaggagggcaagaucguccacauuuccacccuuagcggguccgcccaacauguugaagagugcucuuguuaccccagauauccuggagugcggugcgugugucgcgacaacuggaagggcagcaauagacccaucgucgauauuaacgugaaagacuacuccaucguuagcucuuacgugugcuccggccuggucggggacacaccgcggaagaaugauagcuucucuagcucccacugucucgacccuaacaaugaagagggaggccauggggugaaaggaugggcuuuugaugacggcaacgauguuuggauggggcgcaccauuucugaaaagcugagaagcggauaugagacguucaaagugaucgagggcugguccaagcccaauagcaaacugcagaucaaccggcaggucauuguggaacgcggcaauagaucuggguacuccggaaucuuuagcgucgagggcaagucuugcauuaaccgguguuucuauguggaacucaucagagggcgcaaggaggaaacagagguuugguggaccuccaauagcauuguggucuuuugcggaaccuccggcacauacgggaccggcucuuggccugacggagccgauaucaaccugaugcccauuuga

SEQ ID NO: 204771 - RNA, 1410 nt, Artificial Sequence; identical to SEQ ID NO: 197249
  derived and/or modified sequence opt5 from neuraminidase__InfluenzaA__AFD63947

SEQ ID NO: 204772 - RNA, 1410 nt, Artificial Sequence; identical to SEQ ID NO: 197249
  derived and/or modified sequence opt5 from neuraminidase__InfluenzaA__AFD63958

SEQ ID NO: 204773 - RNA, 1410 nt, Artificial Sequence; identical to SEQ ID NO: 197249
  derived and/or modified sequence opt5 from neuraminidase__InfluenzaA__AFD63969

SEQ ID NO: 204774 - RNA, 1410 nt, Artificial Sequence; identical to SEQ ID NO: 197249
  derived and/or modified sequence opt5 from neuraminidase__InfluenzaA__AFD63980

SEQ ID NO: 204775 - RNA, 1410 nt, Artificial Sequence
  derived and/or modified sequence opt5 from neuraminidase__InfluenzaA__AFD64002
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaccgauucuuucagcuccucucacugucucgacccgaauaacgaagagggaggccauggggugaaaggaugggccuuugaugacggcaaugauguuuggauggggcgcaccauuagcgaaaagcugagauccggauaugagacguucaaagugaucgagggcuggagcaagccuaacucuaaacugcagaucaaucggcaggucauuguggaacgcggcaacagauccggguacagcggaaucuuuucugucgagggcaaguccugcauuaaucgguguuucuauguggaacucaucagagggcgcaaggaggaaacagagguuugguggaccagcaacuccauuguggucuuuugcggaaccucuggcacauacgggaccggcagcuggcccgacggagcugauaucaaucugaugccuauuuga

SEQ ID NO: 204776 - RNA, 1410 nt, Artificial Sequence; identical to SEQ ID NO: 197159
  derived and/or modified sequence opt5 from neuraminidase__InfluenzaA__AFD64013

SEQ ID NO: 204777 - RNA, 1410 nt, Artificial Sequence
  derived and/or modified sequence opt5 from neuraminidase__InfluenzaA__AFD64024
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagaagaauaucacagaaauuguguaccucaccaacacaaccaucgagaaagaaauuuguccuaagcuggcggaguauagaaauuggagcaaaccccagugcaacaucacgggguucgcuccuuuuuccaaggacaauucuauucggcuuagcgccggaggcgauaucugggucacccgcgagcccuacguguccugugacccugauaagugcuaucaauucgcccuggggcagggaacaacccucaacaauggccacucuaacgacacaguucaugauagaaccccguaccggacgcugcugaugaaugaacucggggugcccuuucaccugggaacacgccaggucuguaucgcuuggagcuccagcucuugccaugacggcaaagccuggcuucacguguguguuaccggcgaugacaagaacgcuacagccuccuucauuuauaaugggagacugguggauagcaucggaucuugguccaaaaagauucuccggacccaggagagcgaaugcgucuguaucaacgggaccugcacaguggugaugacggacggcucugcguccggaaaagccgauaccaagauucuguuuaucgaggagggcaagaucguccacauuagcacacuuuccgggucugcucaacauguugaagagugcagcuguuacccucgcuaucccggagugagaugcgugugucgggacaacuggaaaggcuccaaucgcccuaucgucgauauuaacgugaaggacuacagcaucguuucuuccuacgugugcagcggccuggucggggacacccccagaaagaaugauucuuucagcuccucucacugucucgacccgaacaaugaagagggaggccauggggugaaaggaugggccuuugaugacggcaacgauguuuggauggggcggacaauuagcgaaaaacugcgcuccggauaugagaccuucaaggugaucgagggcuggagcaaaccuaauucuaagcugcagaucaacagacaggucauuguggaacggggcaaucgcuccggguacagcggaaucuuuucugucgagggcaaguccugcauuaacagauguuucuauguggaacucauccgggggagaaaagaggaaacggagguuugguggacaagcaauuccauuguggucuuuugcggaaccucuggcaccuacgggacaggcagcuggcccgacggagcugauaucaaccugaugccuauuuga

SEQ ID NO: 204778 - RNA, 1410 nt, Artificial Sequence
  derived and/or modified sequence opt5 from neuraminidase__InfluenzaA__AFD64035
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaacggagguuugguggacaagcaauuccguggucguguuuugcggaaccucuggcaccuacgggacaggcagcuggcccgacggagcugauauuaaccugaugccuaucuga

SEQ ID NO: 204779 - RNA, 1410 nt, Artificial Sequence
  derived and/or modified sequence opt5 from neuraminidase__InfluenzaA__AFD64046
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaacggacgccguaccgcacacugcugaugaaugagcucggggugcccuuucaccugggaaccagacaggucuguaucgccuggagcuccagcucuugccaugauggcaaggcuuggcuucacguguguguuacaggcgacgauaaaaacgccaccgcuuccuucauuuauaaugggcggcugguggacagcaucggaucuugguccaagaaaauucuccgcacccaggaaagcgagugcgucuguaucaacggcacaugcacgguggugaugaccgaugggucugccuccggaaaggcggacacaaaaauucuguuuaucgaggaaggcaagaucguccacauuagcacccuuuccgggucugcccaacauguugaggaaugcagcuguuacccuagauaucccggagugcggugcgugugucgcgauaacuggaagggcuccaauagaccuaucgucgacauuaacgugaaagauuacagcaucguuucuuccuacgugugcagcggccuggucggggacacaccccggaagaaugacucuuucagcuccucucacugucucgauccgaacaaugaggaaggaggccauggggugaaaggaugggcuuuugacgauggcaacgacguuuggauggggcgcaccauuagcgagaagcugagauccggauaugagacguucaaagugaucgaaggcuggagcaagccuaauucuaaacugcagaucaaccggcaggucauuguggagcgcggcaauagauccggguacagcggaaucuuuucugucgaaggcaaguccugcauuaaccgguguuucuauguggagcucaucagagggcgcaaggaagagacagagguuugguggaccagcaauuccauuguggucuuuugcggaaccucuggcacauacgggaccggcagcuggcccgauggagccgacaucaaccugaugccuauuuga

SEQ ID NO: 204780 - RNA, 1410 nt, Artificial Sequence; identical to SEQ ID NO: 204754
  derived and/or modified sequence opt5 from neuraminidase__InfluenzaA__AFD64057

SEQ ID NO: 204781 - RNA, 1410 nt, Artificial Sequence
  derived and/or modified sequence opt5 from neuraminidase__InfluenzaA__AFD64068
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacaaccggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaaaagauccugcggacccaggagucugaaugugugugcauuaacgggacauguacgguggucaugaccgacggauccgcuagcggcaaagccgauacaaagauccucuuuaucgaggaggggaagauuguucacaccuccacacugucuggaagcgcgcaacacguggaagagugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcucccauugccuggacccgaacaaugaagagggcgggcacggagugaaaggcugggccuucgaugacgggaacgauguuuggaugggacggacgaucagcgaaaaaucucgcuccggcuacgagacauuuaaggugaucgagggguggagcaauccuaacucuaaacuccagauuaauagacaggucaucguggaccggggaaaccgcuccggcuauagcggcauuuucuccgucgaagggaagucuuguaucaauagaugcuuuuacguggagcugauucggggaagaaaggaagagaccgaaguucuguggaccagcaacuccaucguggucuucuguggcacaucugggaccuauggaacaggcagcuggcccgauggggcugacauuaaucucaugccuaucuga

SEQ ID NO: 204782 - RNA, 1410 nt, Artificial Sequence
  derived and/or modified sequence opt5 from neuraminidase__InfluenzaA__AFD64079
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgcaucagcgccggaggcgauaucugggucaccagagagcccuacguguccugugacccugauaagugcuaucaauucgcccuugggcagggaacaacccugaacaauggccacucuaacgacacaguucaugaucggaccccguaccgcacgcuccugaugaaugaacugggggugcccuuucaccucggaacaagacaggucuguauugcuuggagcuccagcucuugccaugacggcaaggccuggcugcacguguguguuaccggcgaugacaaaaacgcuacagccuccuucaucuauaaugggcggcuuguggauagcauuggaucuugguccaagaaaauccugcgcacccaggagagcgaaugcgucuguauuaacgggaccugcacaguggugaugacggacggcucugcguccggaaaggccgauaccaaaauccucuuuaucgaggagggcaagauuguccacaucagcacacuguccgggucugcucaacauguugaagagugcagcuguuacccuagauaucccggagugcggugcgugugucgcgacaacuggaagggcuccaauagaccuauugucgauaucaacgugaaagacuacagcauuguuucuuccuacgugugcagcggccuugucggggacacaccccggaagaaugauucuuucagcuccucucacugucuggacccgaacaaugaagagggaggccauggggugaaaggaugggccuuugaugacggcaacgauguuuggauggggcgcaccaucagcgaaaagcucagauccggauaugagaccuucaaagugaucgagggcuggagcaagccuaauucuaaacugcagauuaaccggcaggucaucguggaacgcggcaauagauccggguacagcggaaucuuuucugucgagggcaaguccugcauuaaccgguguuucuauguggaacugauuagagggcgcaaggaggaaacggagguuugguggacaagcaauuccaucguggucuuuugcggaaccucuggcaccuacgggacaggcagcuggcccgacggagcugauauuaaccucaugccuaucuga

SEQ ID NO: 204783 - RNA, 1410 nt, Artificial Sequence; identical to SEQ ID NO: 197249
  derived and/or modified sequence opt5 from neuraminidase__InfluenzaA__AFD64090

SEQ ID NO: 204784 - RNA, 1410 nt, Artificial Sequence
  derived and/or modified sequence opt5 from neuraminidase__InfluenzaA__AFD64101
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugggcggaccccguaccgcacgcugcugaugaaugaacucggagugcccuuucaccugggcacaagacaggucuguaucgcuuggagcuccagcucuugccaugauggcaaggccuggcuucacguguguguuaccggggacgauaaaaacgcuacagccuccuucauuuauaauggacggcugguggacagcaucggcucuugguccaagaaaauucuccgcacccaggagagcgaaugcgucuguaucaacgggaccugcacaguggugaugacggauggaucugcguccggcaaggccgacaccaaaauucuguuuaucgaggaggggaagaucguccacauuagcacacuuuccggaucugcucaacauguugaagagugcagcuguuacccuagauaucccggcgugcggugcgugugucgcgauaacuggaagggcuccaauagaccuaucgucgacauuaacgugaaagauuacagcaucguuucuuccuacgugugcagcgggcuggucggagacacaccccggaagaaugacucuuucagcuccucucacugucucgauccgaacaaugaagagggcgggcauggagugaaaggcugggccuuugacgaugggaacgacguuuggaugggacgcaccauuagcgaaaagcugagauccggcuaugagaccuucaaagugaucgagggcuggagcaagccuaauucuaaacugcagaucaaccggcaggucauuguggaacgcgggaauagauccggauacagcggcaucuuuucugucgaggggaaguccugcauuaaccgguguuucuauguggaacucaucagaggacgcaaggaggaaacggagguuugguggacaagcaauuccauuguggucuuuugcggcaccucugggaccuacggcacaggaagcuggcccgauggcgcugacaucaaccugaugccuauuuga

SEQ ID NO: 204785 - RNA, 1410 nt, Artificial Sequence
  derived and/or modified sequence opt5 from neuraminidase__InfluenzaA__AFD64112
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacaaaaacgccaccgcuuccuucauuuacaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucauucacaucagcacccuuuccgggucugcccaacacgucgaagagugcagcuguuauccuagauaccccggaguucggugcgugugucgcgacaacuggaagggcuccaauagaccuauuguggauaucaacgucaaagacuacagcauugugucuuccuauguuugcagcggccuggugggggacacaccccggaagaaugauucuagcuccucuagccauugucucgacccgaacaaugaagagggaggccacggggucaaaggaugggcuuucgaugacggcaacgauguguggauggggcgcaccaucuccgaaaagcugagaagcggauacgagacguuuaaaguuaucgagggcuggucuaagccuaauuccaaacugcagauuaaccgccaggugaucgucgaacgggacaauagaagcggcuauucugggauuuucuccguggagggaaagagcugcaucaaccgguguuuuuacgucgaacucauuagaggccgcaaggaggaaacagaggugugguggaccuccaauucuaucguuguguucugcgggaccagcggaacauauggcaccggguccuggcccgauggcgccgacauuaaccugaugccuaucuga

SEQ ID NO: 204786 - RNA, 1410 nt, Artificial Sequence; identical to SEQ ID NO: 198955
  derived and/or modified sequence opt5 from neuraminidase__InfluenzaA__AFD64123

SEQ ID NO: 204787 - RNA, 1410 nt, Artificial Sequence; identical to SEQ ID NO: 197249
  derived and/or modified sequence opt5 from neuraminidase__InfluenzaA__AFD64134

SEQ ID NO: 204788 - RNA, 1410 nt, Artificial Sequence; identical to SEQ ID NO: 197249
  derived and/or modified sequence opt5 from neuraminidase__InfluenzaA__AFD64145

SEQ ID NO: 204789 - RNA, 1410 nt, Artificial Sequence; identical to SEQ ID NO: 197249
  derived and/or modified sequence opt5 from neuraminidase__InfluenzaA__AFD64156

SEQ ID NO: 204790 - RNA, 1410 nt, Artificial Sequence; identical to SEQ ID NO: 197169
  derived and/or modified sequence opt5 from neuraminidase__InfluenzaA__AFD64167

SEQ ID NO: 204791 - RNA, 1410 nt, Artificial Sequence; identical to SEQ ID NO: 197249
  derived and/or modified sequence opt5 from neuraminidase__InfluenzaA__AFD64181

SEQ ID NO: 204792 - RNA, 1410 nt, Artificial Sequence
  derived and/or modified sequence opt5 from neuraminidase__InfluenzaA__AFD64192
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacguuagcacacuuuccgggucugcucaacauguggaagagugcagcuguuacccuagauaucccggagugcggugcgucugucgcgacaacuggaagggcuccaauagaccuauuguggauaucaacguuaaagacuacagcauugugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccaucagcgaaaagcugagauccggauaugagaccuucaaagucauugagggcuggagcaagccuaauucuaaacugcagaucaaccgccaggugaucgucgaacggggcaauagauccggguacagcggaaucuuuucuguggagggcaaguccugcauuaaccgguguuucuauguugaacucauuagagggcgcaaggaggaaacggaggugugguggacaagcaauuccaucgucguguuuugcggaaccucuggcaccuacgggacaggcagcuggcccgacggagcugauauuaaccugaugccuaucuga

SEQ ID NO: 204793 - RNA, 1410 nt, Artificial Sequence
  derived and/or modified sequence opt5 from neuraminidase__InfluenzaA__AFD64203
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaaucggcacucuaacgacacaguucaugaucgcaccccguacagaacgcugcugaugaaugaacucggcgugcccuuucaccuggggacacggcaggucuguaucgcuuggagcuccagcucuugccaugacggaaaggccuggcuucacguguguguuaccggcgaugacaaaaacgcuacagccuccuucauuuauaauggccgccugguggauagcaucgggucuugguccaagaaaauucucagaacccaggagagcgaaugcgucuguaucaacggaaccugcacaguggugaugacggacggcucugcguccgggaaggccgauaccaaaauucuguuuaucgaggagggaaagaucguccacauuagcacacuuuccggcucugcucaacauguugaagagugcagcuguuacccucgguaucccggggugcgcugcguguguagagacaacuggaagggauccaaucggccuaucgucgauauuaacgugaaagacuacagcaucguuucuuccuacgugugcagcggccuggucggcgacacaccccgcaagaaugauucuuucagcuccucucacugucucgacccgaacaaugaagaagggggacauggcgugaaagggugggccuuugaugacggaaacgauguuuggaugggcagaacccugagcgagaagcugcgguccggguaugagaccuucaaagugauugagggauggagcaagccuaauucuaaacuccagaucaaccgccaggucaucguggaaagaggcaaucgguccggcuacagcgggaucuuuucugucgagggaaaguccugcauuaacagauguuucuauguggaacugauucgcggccggaaggaggaaacggagguuugguggacaagcaauuccaucguggucuuuugcgggaccucuggaaccuacggcacagggagcuggcccgacggcgcugauauuaaccuuaugccuaucuga

SEQ ID NO: 204794 - RNA, 1410 nt, Artificial Sequence; identical to SEQ ID NO: 204754
  derived and/or modified sequence opt5 from neuraminidase__InfluenzaA__AFD64214

SEQ ID NO: 204795 - RNA, 1410 nt, Artificial Sequence; identical to SEQ ID NO: 198953
  derived and/or modified sequence opt5 from neuraminidase__InfluenzaA__AFD64225

SEQ ID NO: 204796 - RNA, 1410 nt, Artificial Sequence; identical to SEQ ID NO: 197249
  derived and/or modified sequence opt5 from neuraminidase__InfluenzaA__AFD64317

SEQ ID NO: 204797 - RNA, 1410 nt, Artificial Sequence; identical to SEQ ID NO: 198955
  derived and/or modified sequence opt5 from neuraminidase__InfluenzaA__AFD64328

SEQ ID NO: 204798 - RNA, 1410 nt, Artificial Sequence; identical to SEQ ID NO: 204754
  derived and/or modified sequence opt5 from neuraminidase__InfluenzaA__AFD64339

SEQ ID NO: 204799 - RNA, 1410 nt, Artificial Sequence; identical to SEQ ID NO: 197249
  derived and/or modified sequence opt5 from neuraminidase__InfluenzaA__AFD64350

SEQ ID NO: 204800 - RNA, 1410 nt, Artificial Sequence; identical to SEQ ID NO: 204754
  derived and/or modified sequence opt5 from neuraminidase__InfluenzaA__AFD64361

SEQ ID NO: 204801 - RNA, 1410 nt, Artificial Sequence; identical to SEQ ID NO: 204754
  derived and/or modified sequence opt5 from neuraminidase__InfluenzaA__AFD64372

SEQ ID NO: 204802 - RNA, 1410 nt, Artificial Sequence; identical to SEQ ID NO: 197249
  derived and/or modified sequence opt5 from neuraminidase__InfluenzaA__AFD64383

SEQ ID NO: 204803 - RNA, 1410 nt, Artificial Sequence; identical to SEQ ID NO: 204754
  derived and/or modified sequence opt5 from neuraminidase__InfluenzaA__AFD64394

SEQ ID NO: 204804 - RNA, 1410 nt, Artificial Sequence; identical to SEQ ID NO: 197249
  derived and/or modified sequence opt5 from neuraminidase__InfluenzaA__AFD64405

SEQ ID NO: 204805 - RNA, 1410 nt, Artificial Sequence; identical to SEQ ID NO: 197249
  derived and/or modified sequence opt5 from neuraminidase__InfluenzaA__AFD64416

SEQ ID NO: 204806 - RNA, 1410 nt, Artificial Sequence; identical to SEQ ID NO: 197249
  derived and/or modified sequence opt5 from neuraminidase__InfluenzaA__AFD64427

SEQ ID NO: 204807 - RNA, 1410 nt, Artificial Sequence
  derived and/or modified sequence opt5 from neuraminidase__InfluenzaA__AFD64438
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaucuggcggaguaucggaacuggagcaaaccccagugcaauaucacgggguucgcuccuuuuuccaaggacaacucuauucgccuuagcgccggaggcgauaucugggucaccagagagcccuacguguccugugacccugauaaaugcuaucaauucgcccuggggcagggaacaacccucaauaacggccacucuaaugacacaguucaugaucggaccccguaccgcacgcugcugaugaacgaacucggggugcccuuucaccugggaacaagacaggucuguaucgcuuggagcuccagcucuugccaugacggcaaggccuggcuucacguguguguuaccggcgaugacaagaaugcuacagccuccuucauuuauaacgggcggcugguggauagcaucggaucuugguccaaaaagauucuccgcacccaggagagcgaaugcgucuguaucaacgggaccugcacaguggugaugacggacggcucugcguccggaaaagccgauaccaagauucuguuuaucgaggagggcaaaaucguccacauuagcacacuuuccgggucugcucaacauguugaagagugcagcuguuacccuagauaucccggagugcggugcgugugucgcgacaauuggaagggcuccaacagaccuaucgucgauauuaaugugaaggacuacagcaucguuucuuccuacgugugcagcggccuggucggggacacaccccggaaaaacgauucuuucagcuccucucacugucucgacccgaauaacgaagagggaggccauggggugaagggaugggccuuugaugacggcaaugauguuuggauggggcgcaccauuagcgaaaaacugagauccggauaugagaccuucaaggugaucgagggcuggagcaaaccuaacucuaagcugcagaucaaucggcaggucauuguggaacgcggcaacagauccggguacagcggaaucuuuucugucgagggcaaauccugcauuaaucgguguuucuauguggaacucaucagagggcgcaaggaggaaacggagguuugguggacaagcaacuccauuguggucuuuugcggaaccucuggcaccuacgggacaggcagcuggcccgacggagcugauaucaaucugaugccuauuuga

SEQ ID NO: 204808 - RNA, 1410 nt, Artificial Sequence; identical to SEQ ID NO: 197249
  derived and/or modified sequence opt5 from neuraminidase__InfluenzaA__AFD64449

SEQ ID NO: 204809 - RNA, 1410 nt, Artificial Sequence; identical to SEQ ID NO: 197169
  derived and/or modified sequence opt5 from neuraminidase__InfluenzaA__AFD64460

SEQ ID NO: 204810 - RNA, 1410 nt, Artificial Sequence; identical to SEQ ID NO: 204167
  derived and/or modified sequence opt5 from neuraminidase__InfluenzaA__AFD98098

SEQ ID NO: 204811 - RNA, 1410 nt, Artificial Sequence
  derived and/or modified sequence opt5 from neuraminidase__InfluenzaA__AFD98120
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucguggacaaaggaaaccgcagcggcuacucuggcauuuucuccgucgaggggaagucuuguaucaauagaugcuuuuauguggaacugauucggggaagaaaggaggaaaccgagguucucuggacauccaacucuaucguggucuucuguggcaccagcgggacauacggaacgggcuccuggcccgauggggcugaccugaaucuuaugccuauuuga

SEQ ID NO: 204812 - RNA, 1410 nt, Artificial Sequence; identical to SEQ ID NO: 202542
  derived and/or modified sequence opt5 from neuraminidase__InfluenzaA__AFD98131

SEQ ID NO: 204813 - RNA, 1410 nt, Artificial Sequence; identical to SEQ ID NO: 204167
  derived and/or modified sequence opt5 from neuraminidase__InfluenzaA__AFD98142

SEQ ID NO: 204814 - RNA, 1410 nt, Artificial Sequence; identical to SEQ ID NO: 204811
  derived and/or modified sequence opt5 from neuraminidase__InfluenzaA__AFD98164

SEQ ID NO: 204815 - RNA, 1410 nt, Artificial Sequence
  derived and/or modified sequence opt5 from neuraminidase__InfluenzaA__AFD98175
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucacgaucggacgccguaucgcacacuccugaugaaugaacugggcgugcccuuucaucucgggaccaagcaggucugcauugccugguccagcagcuccugucacgacggaaaagccuggcugcaugugugcaucacaggcgaugacaagaacgcuaccgccagcuucauuuacaauggcagacuuguugauucuguggucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagaccauucuauuguuuccagcuacguguguucuggacuugucggcgacacccccagaaagaaugauagcuccucuagcucccacugccuggacccgaacaaugaggaaggcgggcauggagugaaaggcugggccuucgaugacgggaacgauguuuggaugggacggacgaucaaugagacaagccgccucggcuaugagaccuuuaaggugaucgaaggguggucuaacccuaaauccaagcugcagauuaauagacaggucaucguggacaaaggaaaccggagcggcuacucuggcauuuucuccgucgaggggaagucuuguaucaaucgcugcuuuuauguggaacugauuagaggacggaaggaggaaaccgagguucucuggacauccaacucuaucguggucuucuguggcaccagcgggacauacggaacgggcuccuggcccgauggggcugaccugaaucuuaugccuauuuga

SEQ ID NO: 204816 - RNA, 1410 nt, Artificial Sequence
  derived and/or modified sequence opt5 from neuraminidase__InfluenzaA__AFD98186
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuguugaggaagggaagaucgugcauaccuccacacugucuggaagcgcgcaacacguggaggaaugcuccugcuauccucgcuaccccggcgucagaugugugugccgggacaacuggaaagggagcaaucgcccuauuguugauaucaacauuaaggaccacucuaucauuuccagcuacguguguucuggacuugucggcgacacccccagaaagaaugauagcuccucuagcucccauugccuggacccgaacaaugaggaaggcgggcacggagugaagggcugggccuucgaugacgggaacgauguuuggaugggacggacgaucaaugagacaagccgccucggcuaugagaccuuuaaagugaucgaaggguggucuaacccuaaguccaaacugcagauuaauagacaggucaucguggaccggggaaaccgcagcggcuacucuggcauuuucuccgucgaggggaaaagcuguaucaauagaugcuuuuauguggaacugauucggggaagaaaggaggaaaccgagguucucuggacauccaacucuaucguggucuucuguggcaccagcgggacauacggaacgggcuccuggcccgauggggcugaccugaaucuuaugccuauuuga

SEQ ID NO: 204817 - RNA, 1410 nt, Artificial Sequence; identical to SEQ ID NO: 202542
  derived and/or modified sequence opt5 from neuraminidase__InfluenzaA__AFD98197

SEQ ID NO: 204818 - RNA, 1410 nt, Artificial Sequence; identical to SEQ ID NO: 203279
  derived and/or modified sequence opt5 from neuraminidase__InfluenzaA__AFD98208

SEQ ID NO: 204819 - RNA, 1410 nt, Artificial Sequence
  derived and/or modified sequence opt5 from neuraminidase__InfluenzaA__AFD98218
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccagcagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucgacgagacaagcagacugggcuaugagaccuuuaaggugaucgaaggguggucuaaucccaaauccaagcuccagauuaaccggcaggucaucguggauaaaggaaaucgcagcggcuacucuggcauuuucuccgucgaggggaagucuuguaucaacagaugcuuuuauguggaacugauucggggaagaaaggaggaaaccgagguucuguggacauccaauucuaucguggucagcuguggcaccuccgggacauacggaacgggcucuuggccugacggggcugaucucaaccugaugcccauuuga

SEQ ID NO: 204820 - RNA, 1410 nt, Artificial Sequence; identical to SEQ ID NO: 202542
  derived and/or modified sequence opt5 from neuraminidase__InfluenzaA__AFD98229

SEQ ID NO: 204821 - RNA, 1410 nt, Artificial Sequence; identical to SEQ ID NO: 202542
  derived and/or modified sequence opt5 from neuraminidase__InfluenzaA__AFD98240

SEQ ID NO: 204822 - RNA, 1410 nt, Artificial Sequence; identical to SEQ ID NO: 204811
  derived and/or modified sequence opt5 from neuraminidase__InfluenzaA__AFD98251

SEQ ID NO: 204823 - RNA, 1410 nt, Artificial Sequence; identical to SEQ ID NO: 204811
  derived and/or modified sequence opt5 from neuraminidase__InfluenzaA__AFD98262

SEQ ID NO: 204824 - RNA, 1410 nt, Artificial Sequence; identical to SEQ ID NO: 203733
  derived and/or modified sequence opt5 from neuraminidase__InfluenzaA__AFD98273

SEQ ID NO: 204825 - RNA, 1410 nt, Artificial Sequence; identical to SEQ ID NO: 203281
  derived and/or modified sequence opt5 from neuraminidase__InfluenzaA__AFD98283

SEQ ID NO: 204826 - RNA, 1410 nt, Artificial Sequence; identical to SEQ ID NO: 202542
  derived and/or modified sequence opt5 from neuraminidase__InfluenzaA__AFD98293

SEQ ID NO: 204827 - RNA, 1410 nt, Artificial Sequence; identical to SEQ ID NO: 203733
  derived and/or modified sequence opt5 from neuraminidase__InfluenzaA__AFD98313

SEQ ID NO: 204828 - RNA, 1410 nt, Artificial Sequence; identical to SEQ ID NO: 203281
  derived and/or modified sequence opt5 from neuraminidase__InfluenzaA__AFD98323

SEQ ID NO: 204829 - RNA, 1410 nt, Artificial Sequence; identical to SEQ ID NO: 203733
  derived and/or modified sequence opt5 from neuraminidase__InfluenzaA__AFD98333

SEQ ID NO: 204830 - RNA, 1410 nt, Artificial Sequence; identical to SEQ ID NO: 204811
  derived and/or modified sequence opt5 from neuraminidase__InfluenzaA__AFD98343

SEQ ID NO: 204831 - RNA, 1410 nt, Artificial Sequence
  derived and/or modified sequence opt5 from neuraminidase__InfluenzaA__AFD98354
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggaaacgcuuccggcaaggccgauacaaaaauccucuuuaucgaggaagggaagauuguucauaccagcacacugcuuggauccgcgcaacacguggaggaaugcucuugcuauccuagauaccccggcgugcggugugucugccgcgacaauuggaaggggagcaacagaccuaucguggauauuaauaucaaagaccacuccauuguuagcucuuacguguguuccggacuggucggcgacacgccccggaagaacgauagcucuagcuccucucauugccucgacccgaauaacgaggaaggcgggcacggagugaaaggcugggccuucgaugacgggaaugauguuuggaugggacgcaccaucaacgagacaagcagacugggcuaugagaccuuuaaggugaucgaagggugguccaauccuaaaagcaagcugcagauuaaccggcaggucaucguggacaaaggaaaucgcucuggcuacuccggcauuuucagcgucgaggggaagucuuguaucaacagaugcuuuuauguggaacucauucggggaagaaaggaggaaaccgagguucuguggacauccaauagcaucguggucuucuguggcaccuccgggacauacggaacgggcucuuggcccgauggggcugaccuuaaccugaugccuauuuga

SEQ ID NO: 204832 - RNA, 1410 nt, Artificial Sequence
  derived and/or modified sequence opt5 from neuraminidase__InfluenzaA__AFD98365
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccucuagcuccugucaugacggaaaagccuggcugcacgugugcaucacaggcgaugacaagaaugcuaccgccagcuucauuuauaacggccggcuuguugauucuguggucuccuggagcaaagagauccugcgcacccaggaaucugagugugugugcauuaaugggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuacccuagauaccccggcgugcggugugucugccgcgacaacuggaaggggagcaacagaccuaucguggauauuaauaucaaagaccacucuauuguuuccagcuauguguguucuggacuugucggcgacacgccccggaagaacgauagcuccucuagcucccauugccuggacccgaauaacgaggaaggcgggcacggagugaaaggcugggccuucgaugacgggaaugauguuuggaugggacgcaccaucaacgagacaagcagacucggcuacgagaccuuuaaggugaucgaaggguggucuaauccuaaauccaagcugcagauuaaccggcaggucaucguggaccgcggaaauagaagcggcuauucuggcauuuucuccgucgaggggaaaagcuguaucaaccggugcuuuuacguggaacugauuagaggacgcaaggaggaaaccaagguucucuggacauccaauucuaucguggucuucuguggcaccagcgggacauauggaacgggcuccuggcccgauggggcugaccugaaccuuaugccuauuuga

SEQ ID NO: 204833 - RNA, 1410 nt, Artificial Sequence
  derived and/or modified sequence opt5 from neuraminidase__InfluenzaA__AFD98376
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacucgcugaguaccggaauuggagcaagccccagugugacauuaccggguuugccccuuucuccaaagauaacucuauccgccugagcgcgggaggcgacaucugggugacaagagagcccuaugucuccugcgauccugacaaguguuaccaauuugcucuugggcagggaaccacacugaauaacgugcauucuaauaacaccguucgggaucgcacgccguauagaacacuccugaugaaugaacugggcgugcccuuccaccucgggaccaagcaggucugcauugccuggagcuccagcucuugucaugacggaaaagccuggcugcacgugugcaucacaggcgaugacaagaacgcuaccgccuccuuuauuuacaauggccggcuuguugauagcguggucucuugguccaaagagauccugcgcacccaggaaagcgagugugugugcauuaacgggacauguacgguggucaugaccgacggaucugcuuccggcaaggccgauacaaaaauccucuucaucgaggaagggaagauuguucauaccagcacacuguccggaucugcgcaacacguggaggaaugcagcugcuauccuagauaccccggcgugcggugugucugccgcgacaacuggaagggguccaauagaccuaucguggauauuaacaucaaagaccacagcauuguuucuuccuacguguguagcggacuugucggcgacacgccccggaagaaugauucuagcuccucuggccauugccuggacccgaacaaugaggaagggggacacggcgugaaagggugggccuuugaugacggaaacgauguuuggaugggccgcaccaucaaugagacaagcagacucggguaugagaccuucaaggugaucgaaggaugguccaacccuaaaagcaagcugcagauuaaucggcaggucaucguggacaaaggcaaccgcucuggcuacuccgggauuuuuagcgucgagggaaagucuuguaucaauagaugcuucuauguggaacugauucggggcagaaaggaggaaaccgagguucucuggacauccaacagcaucguggucuucugugggaccuccggaacauacggcacggggucuuggcccgauggcgcugaccugaaucuuaugccuauuuga

SEQ ID NO: 204834 - RNA, 1410 nt, Artificial Sequence
  derived and/or modified sequence opt5 from neuraminidase__InfluenzaA__AFD98387
augaaccccaaucagaagaucauuaccaucggcagcgugucccugacaauuucuacgaucugcuuccucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacuggcugaguaccgggacugguccaagccccagugugauauuaccggguuugccccuuucucuaaagacaauagcauccgccuuuccgcgggaggcgauaucugggugacaagagagcccuaugucucuugcgacccugauaaguguuaccaauuugcucuggggcagggaaccacacucaacaaugugcauagcaacaauaccguucgggaccgcacgccguauagaacacugcugaugaacgaacucggcgugcccuuccaccuggggaccaagcaggucugcauugccugguccucuagcuccugucaugauggaaaagccuggcuucacgugugcaucacaggcgacgauaagaaugcuaccgccagcuuuauuuacaacggcaaacugguugacucuguggucuccuggagcaaggagauccuccggacccaggaaucugagugugugugcauuaaugggacauguacgguggucaugaccgauggauccgcuagcggcaaagccgacacaaagauccuguucaucgaggaagggaagauuguucauaccuccacacuuucuggaagcgcgcaacacguggaggaaugcuccugcuauccucgcuaccccggcgugagaugugucugccgggauaacuggaaagggagcaaccgcccuaucguggacauuaauaucaaggaccacucuauuguuuccagcuacguguguucuggacuggucggcgauacccccagaaagaacgaccggagcuccaauucucauugccucgauccgaacaaugaggaaggcgggcacggagugaaaggcugggccuuugacgaugggaacgacguuuggaugggacgcacgaucaaugagacaagcagacugggcuaugagaccuucaaagugaucgaagggugguccaacccuaagagcaaacugcagauuaaucggcaggucaucguggaucgcggaaacagaucuggcuacuccggcauuuuuagcgucgaggggaagucuuguaucaaucggugcuucuauguggaacucauuagaggacgcaaggaggaaaccgagguucuguggacauccaacagcaucguggucuuuuguggcaccuccgggacauacggaacgggcucuuggcccgacggggcugaucuuaaucugaugccuauuuga

SEQ ID NO: 204835 - RNA, 1410 nt, Artificial Sequence
  derived and/or modified sequence opt5 from neuraminidase__InfluenzaA__AFD98398
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggacccggcaggucugcauugccugguccucuagcuccugucaugacggaaaggccuggcugcacgugugcaucacaggcgaugacaaaaacgcuaccgccagcuucauuuacaauggccgccuuguugauucuguggucuccuggagcaaggagauccugagaacccaggaaucugagugugugugcauuaacgggacauguacgguggucaugaccgacggauccgcuagcggcaaagccgauacaaagauccucuuuaucgaggaagggaaaauuguucauaccuccacacugucuggaagcgcgcaacacguggaggaaugcuccugcuauccucgguaccccggcgugcgcugugucugcagagacaacuggaaggggagcaaucggccuaucguggauauuaacaucaaggaccacucuauuguuuccagcuacguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucaaugagacaagccggcucggcuaugagaccuuuaaagugaucgaaggguggucuaacccuaaguccaaacugcagauuaaucgccaggucaucguggacaagggaaacagaagcggcuacucuggcauuuucuccgucgaggggaaaagcuguaucaaucggugcuuuuauguggaacugauuagaggacgcaaggaggaaaccgagguucucuggacauccaacucuaucguggucuucuguggcaccagcgggacauacggaacgggcuccuggcccgauggggcugaccugaaucuuaugccuauuuga

SEQ ID NO: 204836 - RNA, 1410 nt, Artificial Sequence
  derived and/or modified sequence opt5 from neuraminidase__InfluenzaA__AFD98409
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcggccauugccuggacccgaacaaugaggaagggggacacggcgugaaagggugggccuucgaugacggaaacgauguuuggaugggccgcaccaucaaugagacauccagacucggguaugagaccuuuaaggugaucgaaggauggagcaacccuaaaucuaagcugcagauuaaucggcaggucaucguggacaaaggcaaccgcuccggcuacagcgggauuuucucugucgagggaaaguccuguaucaauagaugcuuuuauguggaacugauucggggcagaaaggaggaaaccgagguucucuggacaagcaacuccaucguggucuucugugggaccucuggaacauacggcacggggagcuggcccgauggcgcugaccugaaucuuaugccuauuuga

SEQ ID NO: 204837 - RNA, 1410 nt, Artificial Sequence; identical to SEQ ID NO: 204811
  derived and/or modified sequence opt5 from neuraminidase__InfluenzaA__AFD98420

SEQ ID NO: 204838 - RNA, 1410 nt, Artificial Sequence
  derived and/or modified sequence opt5 from neuraminidase__InfluenzaA__AFD98431
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucgugggacgcggcaacagaagcggcuacucugggauuuucuccgucgagggaaaaagcuguaucaaucggugcuuuuauguggaacugauuagaggccgcaaggaggaaaccgagguucucuggacauccaacucuaucguggucuucugugggaccagcggaacauacggcacgggguccuggcccgacggcgcugaucugaaucuuaugccuauuuga

SEQ ID NO: 204839 - RNA, 1410 nt, Artificial Sequence
  derived and/or modified sequence opt5 from neuraminidase__InfluenzaA__AFD98442
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuggggagaucacaugcguuugcagagacaauuggcacggaagcaaccggcccuggguguccuucaaucagaaccuggaauaucagauuggcuacaucuguagcgggauuuuuggagauaauccucgccccaacgacaaaaccggcucuugcgggccgguguccagcaauggagccaacggcgucaagggcuucucuuuuaaguaugggaacggaguguggaucggcagaacaaaauccauuagcucccggaagggguucgagaugaucugggauccuaauggauggaccggcaccgacaacaauuuugcuaucaaacaagacauuguugggaucaacgaauggucuggcuacagcggauccuucgugcagcaucccgagcuuacaggccuggauuguauucgcccuugcuucugggucgaacucaucagagggcggcccaaggagaauacgauuuggaccucuggaagcuccaucagcuuuuguggcgugaacucugacacaguugggugguccuggcccgauggagccgagcugccuuucaccaucgacaaauga

SEQ ID NO: 204840 - RNA, 1410 nt, Artificial Sequence
  derived and/or modified sequence opt5 from neuraminidase__InfluenzaA__AFD98452
augaaccccaaucagaagaucauuacccugggcagcgugucccucacaaucucuacgauuugcuucuuuauccaaauugccauccugaucaccacagucacccuucacuucaaacaguacgaguuuaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccagugugacauuaccggguucgccccuuuuucuaaagauaacagcauccgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcauugccugguccucuagcuccugucaugacggaaaagccuggcuucacgugugcaucacaggcgaugacaagaacgcuaccgccagcuucauuuacaauggccggcugguugauucuguggucuccuggagcaaagagauccuccgcacccaggaaucugagugugugugcauuaacgggacauguacgguggucaugaccgacggauccgcuagcggcaaggccgauacaaaaauccuguuuaucgaggaagggaagauuguucauaccuccacacuuucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuggucggcgacacgccccggaagaaugauagcuccucuagcucccauugccucgacccgaacaaugaggaaggcgggcacggagugaaaggcugggccuucgaugacgggaacgauguuuggaugggacgcaccaucaaugagacaagcagacugggcuaugagaccuuuaaggugaucgaaggguggucuaacccuaaauccaagcugcagauuaaucggcaggucaucguggaccgcggaaacagaagcggcuacucuggcauuuucuccgucgaggggaaaagcuguaucaaucggugcuuuuauguggaacucauuagaggacgcaaggaggaaaccgagguucuguggacauccaacucuaucguggucuucuguggcaccagcgggacauacggaacgggcuccuggcccgauggggcugaccuuaaucugaugccuauuuga

SEQ ID NO: 204841 - RNA, 1410 nt, Artificial Sequence; identical to SEQ ID NO: 204811
  derived and/or modified sequence opt5 from neuraminidase__InfluenzaA__AFD98463

SEQ ID NO: 204842 - RNA, 1410 nt, Artificial Sequence
  derived and/or modified sequence opt5 from neuraminidase__InfluenzaA__AFD98474
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaccggaaccgacaacaauuuuagcaucaaacaagacauuaucggcauuaacgaaugguccggguacucuggcagcuucguucagcaucccgagcuuacaggacuggauuguauccgcccuugcuucuggguggaacucauuagaggccggcccaaggagaauacgaucuggaccuccgggagcucuaucuccuuuuguggagucaacagcgacacagugggcuggucuuggcccgauggggcugagcugccuuucaccauugacaaauga

SEQ ID NO: 204843 - RNA, 1410 nt, Artificial Sequence
  derived and/or modified sequence opt5 from neuraminidase__InfluenzaA__AFD98484
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagaugaaucggcaggucauuguggaccgcggaaacagaagcggcuacucuggcaucuucuccgucgaggggaaaagcuguauuaaucggugcuuuuauguggaacugaucagaggacgcaaggaggaaaccgagguucucuggacauccaacucuauuguggucuucuguggcaccagcgggacauacggaacgggcuccuggcccgauggggcugaccugaaucuuaugccuaucuga

SEQ ID NO: 204844 - RNA, 1410 nt, Artificial Sequence
  derived and/or modified sequence opt5 from neuraminidase__InfluenzaA__AFD98495
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccaacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcgggcacggagugaagggcugggccuucgacgaugggaaugacguuuggaugggacggacgaucaacgagacaagccgccucggcuaugagaccuuuaaagugaucgaaggguggucuaauccuaaguccaaacugcagauuaacagacaggucaucguggaucggggaaaucgcagcggcuacucuggcauuuucuccgucgaggggaaaagcuguaucaacagaugcuuuuauguggaacugauucggggaagaaaggaggaaaccgagguucucuggacauccaauucuaucguggucuucuguggcaccagcgggacauacggaacgggcuccuggcccgacggggcugaucugaaccuuaugccuauuuga

SEQ ID NO: 204845 - RNA, 1410 nt, Artificial Sequence; identical to SEQ ID NO: 204811
  derived and/or modified sequence opt5 from neuraminidase__InfluenzaA__AFD98506

SEQ ID NO: 204846 - RNA, 1410 nt, Artificial Sequence
  derived and/or modified sequence opt5 from neuraminidase__InfluenzaA__AFD98517
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuaucaaggaggggaaaauuguucauaccuccacacugucuggaagcgcgcaacacguggaagagugcuccugcuauccucgcuaccccggcgugagaugugucugccgggacaacuggaaggggagcaaucgcccuaucguggauauuaacaucaaagaccacucuauuguuuccagcuacguguguucuggacuugucggcgacacccccagaaagaaugauagcuccucuagcucccauugccuggacccgaacaaugaagagggcgggcacggagugaaaggcugggccuucgaugacgggaacgauguuuggaugggacggacgaucaaugaaacaagccgccucggcuaugagaccuuuaaggugaucgagggguggucuaacccuaaauccaagcugcagauuaauagacaggucaucguggaccggggaaaccgcagcggcuacucuggcauuuucuccgucgaagggaagucuuguaucaauagaugcuuuuauguggagcugauucggggaagaaaagaagagaccgaaguucucuggacauccaacucuaucguggucuucuguggcaccagcgggacauacggaacgggcuccuggcccgauggggcugaccugaaucuuaugccuauuuga

SEQ ID NO: 204847 - RNA, 1410 nt, Artificial Sequence; identical to SEQ ID NO: 202542
  derived and/or modified sequence opt5 from neuraminidase__InfluenzaA__AFD98528

SEQ ID NO: 204848 - RNA, 1410 nt, Artificial Sequence; identical to SEQ ID NO: 204811
  derived and/or modified sequence opt5 from neuraminidase__InfluenzaA__AFD98539

SEQ ID NO: 204849 - RNA, 1410 nt, Artificial Sequence; identical to SEQ ID NO: 204811
  derived and/or modified sequence opt5 from neuraminidase__InfluenzaA__AFD98550

SEQ ID NO: 204850 - RNA, 1410 nt, Artificial Sequence
  derived and/or modified sequence opt5 from neuraminidase__InfluenzaA__AFD98561
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacaugugcuguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagucugauuccucuagcuccagccauugccuggacccgaauaacgaggaaggcgggcacggagugaaaggcugggcuuucgaugacgggaaugauguuuggaugggacgcaccaucaacgagacgucuagacucggcuaugagacauuuaaggugaucgaagggugguccaauccuaaaagcaagcugcagauuaaccggcaggucaucguggaccgcggaaauagaucuggcuacuccggcauuuucagcgucgaggggaaauccuguaucaaccggugcuuuuauguggaacugauuagaggacgcaaggaggaaaccgagguucucuggaccucuaauagcaucguggucuucuguggcacauccgggaccuacggaacaggcucuuggcccgauggggccgaccugaaccuuaugccuauuuga

SEQ ID NO: 204851 - RNA, 1410 nt, Artificial Sequence
  derived and/or modified sequence opt5 from neuraminidase__InfluenzaA__AFD98572
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgcucgagaaggaaauuugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcaucgccugguccucuagcuccugucaugacggaaaagccuggcuucacgugugcauuacaggcgaugacaagaacgcuaccgccagcuucaucuacaauggccggcugguugauucuguggucuccuggagcaaagagauucuccgcacccaggaaucugagugugugugcaucaacgggacauguacgguggucaugaccgacggauccgcuagcggcaaggccgauacaaaaauucuguuuaucgaggaagggaagaucguucauaccuccacacuuucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuggucggcgacacgccccggaagaaugauagcuccucuagcucccauugccucgacccgaacaaugaggaaggcgggcacggagugaaaggcugggccuucgaugacgggaacgauguuuggaugggacgcaccauuaaugagacaagcagacugggcuaugagaccuuuaaggugaucgaaggguggucuaacccuaaauccaagcugcagaucaaucggcaggucauuguggaccgcggaaacagaagcggcuacucuggcaucuucuccgucgaggggaaaagcuguauuaaucggugcuuuuauguggaacucaucagaggacgcaaggaggaaaccgagguucuguggacauccaacucuauuguggucuucuguggcaccagcgggacauacggaacgggcuccuggcccgauggggcugaccuuaaucugaugccuaucuga

SEQ ID NO: 204852 - RNA, 1410 nt, Artificial Sequence
  derived and/or modified sequence opt5 from neuraminidase__InfluenzaA__AFD98583
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucucgcgauaacagcaucagacuguccgcgggaggcgacaucugggugacacgggagcccuaugucucuugcgauccugacaaauguuaccaauucgcucuugggcagggaaccacacugaauaacgugcauagcaauaacaccguucgcgauagaacgccguaucggacacuccugaugaaugaacugggcgugcccuuucaccucgggaccaagcaggucugcauugccugguccucuagcuccugucaugacggaaaggccuggcugcacgugugcaucacaggcgaugacaaaaacgcuaccgccagcuucauuuacaauggccgccuuguugauucuguggucuccuggagcaaggagauccugagaacccaggaaucugagugugugugcauuaacgggacauguacgguggucaugaccgacggauccgcuagcggcaaagccgauacaaagauccucuuuaucgaggaagggaaaauuguucauaccuccacacugucuggaagcgcgcaacacguggaggaaugcuccugcuauccucgguaccccggcgugcgcugugucugcagagacaacuggaaggggagcaaucggccuaucguggauauuaacaucaaggaccacucuauuguuuccagcuacguguguucuggacuugucggcgacacgccccgcaaaagcgauuccucuagcuccagccauugccuggacccgaauaacgaggaaggcgggcacggagugaagggcugggccuucgaugacgggaaugauguuuggaugggaagaaccaucaacgagacaucucggcucggcuaugagaccuuuaaagugaucgaagggugguccaauccuaagagcaaacugcagauuaaccgccaggucaucguggacagaggaaaucggucuggcuacuccggcauuuucagcgucgaggggaaguccuguaucaacagaugcuuuuauguggaacugauucgcggacggaaagaggaaaccgagguucucuggacaucuaauagcaucguggucuucuguggcaccuccgggacauacggaacgggcucuuggcccgauggggcugaccugaaccuuaugccuauuuga

SEQ ID NO: 204853 - RNA, 1410 nt, Artificial Sequence
  derived and/or modified sequence opt5 from neuraminidase__InfluenzaA__AFE02944
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacugaacuguauccgcccuugcuucuggguggaacucauuagaggccggcccaaagagaauacgguuuggaccuccgggagcucuaucuccuuuuguggagugaacagcgauacagucggcuggucuuggcccgacggggcugagcugccuuucaccauugauaaguga

SEQ ID NO: 204854 - RNA, 1410 nt, Artificial Sequence
  derived and/or modified sequence opt5 from neuraminidase__InfluenzaA__AFE47627
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagacaaacagacaggucaucguggaccggggcaaucgcucuggguauuccggaaucuucagcgucgaguccaagucuugcauuaacagauguuuuuacguggaacucauccggggcagaaagcaggagaccgaaguucuguggaccagcaauuccauuguggucuucugcgggacaucuggaaccuauggcacagggagcuggcccgauggcgccgacaucaaccuuaugccuauuuga

SEQ ID NO: 204855 - RNA, 1410 nt, Artificial Sequence; identical to SEQ ID NO: 204167
  derived and/or modified sequence opt5 from neuraminidase__InfluenzaA__AFF18509

SEQ ID NO: 204856 - RNA, 1410 nt, Artificial Sequence
  derived and/or modified sequence opt5 from neuraminidase__InfluenzaA__AFF57129
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaacggaaccgacaauaacuuuagcaucaaacaagacauuguuggcaucaaugaaugguccggguacucuggcagcuucgugcagcaucccgagcuuaccggacuggauuguauucgcccuugcuucugggucgaacucaucagaggccggcccaaggagaacacaauuuggacguccgggagcucuaucuccuuuuguggagugaauagcgacaccguuggcuggucuuggcccgauggggcugagcugccuuucacaaucgacaaauga

SEQ ID NO: 204857 - RNA, 1410 nt, Artificial Sequence
  derived and/or modified sequence opt5 from neuraminidase__InfluenzaA__AFF57133
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggcuuaaccagaccuauguuaauaucagcaacacaaauuucgcugccgggcaguccguggugucugucaaacuggcgggaaacagcucccucugcccugugagcggcugggcuauuuacucuaaggacaauuccaucagaaucgggagcaaaggagauguuuuugugauucgggagccguucaucucuuguucccccagcgaaugccgcaccuuuuuccugacacagggcgcccuucugaacgacaagcauucuaauggcaccauuaaagauagauccccuuaucggacgcucaugagcugucccaucggggaggucccuucccccuacaacucucgcuuugaaagcguggccugguccgcuagcgccugccacgacggaauuaacuggcugaccaucggcaucucugggccugauaauggagcuguugccgugcugaaguauaacggcauuaucacagacaccauuaaguccuggagaaauaacauccuccggacacaagagagcgagugugcgugcgucaaugggucuuguuucaccauuaugacggauggaccgagcgacggccaggccuccuacaaaaucuuucgcaucgaaaagggcaaaauugugaagucuguggagaugaacgcucccaauuaucauuacgaagagugcagcuguuacccugauuccagcgagaucacaugcgucugcagagacaacuggcacgggucuaaucggcccuggguuuccuucaaccagaaucuggaauaucagauuggauacaucuguagcggcauuuuuggggauaacccucgccccaaugacaaaaccggaucuugcggcccgguguccagcaacggggccaauggagugaagggcuucuccuuuaaguauggcaacggggucuggaucggaagaacaaaaucuauuagcucccggaagggcuucgagaugaucugggauccuaacggguggaccggaaccgacaauaacuuuucuaucaaacaagacauugugggcaucaaugaauggagcggguacuccggcagcuucguucagcaucccgagcuuacaggacuggauuguauucgcccuugcuucuggguggaacucaucagaggccggcccaaggagaacacgauuuggaccucuggguccagcaucucuuuuuguggagucaauuccgacacagugggcuggagcuggcccgauggggcugagcugccuuucaccaucgacaaauga

SEQ ID NO: 204858 - RNA, 1410 nt, Artificial Sequence; identical to SEQ ID NO: 199917
  derived and/or modified sequence opt5 from neuraminidase__InfluenzaA__AFF57137

SEQ ID NO: 204859 - RNA, 1410 nt, Artificial Sequence; identical to SEQ ID NO: 199917
  derived and/or modified sequence opt5 from neuraminidase__InfluenzaA__AFF57141

SEQ ID NO: 204860 - RNA, 1410 nt, Artificial Sequence; identical to SEQ ID NO: 199917
  derived and/or modified sequence opt5 from neuraminidase__InfluenzaA__AFF57145

SEQ ID NO: 204861 - RNA, 1410 nt, Artificial Sequence; identical to SEQ ID NO: 199917
  derived and/or modified sequence opt5 from neuraminidase__InfluenzaA__AFF57149

SEQ ID NO: 204862 - RNA, 1410 nt, Artificial Sequence; identical to SEQ ID NO: 199917
  derived and/or modified sequence opt5 from neuraminidase__InfluenzaA__AFF57153

SEQ ID NO: 204863 - RNA, 1410 nt, Artificial Sequence; identical to SEQ ID NO: 199917
  derived and/or modified sequence opt5 from neuraminidase__InfluenzaA__AFF57157

SEQ ID NO: 204864 - RNA, 1410 nt, Artificial Sequence; identical to SEQ ID NO: 199917
  derived and/or modified sequence opt5 from neuraminidase__InfluenzaA__AFF57161

SEQ ID NO: 204865 - RNA, 1410 nt, Artificial Sequence; identical to SEQ ID NO: 199917
  derived and/or modified sequence opt5 from neuraminidase__InfluenzaA__AFF57165

SEQ ID NO: 204866 - RNA, 1410 nt, Artificial Sequence; identical to SEQ ID NO: 199917
  derived and/or modified sequence opt5 from neuraminidase__InfluenzaA__AFF57169

SEQ ID NO: 204867 - RNA, 1410 nt, Artificial Sequence; identical to SEQ ID NO: 199917
  derived and/or modified sequence opt5 from neuraminidase__InfluenzaA__AFF57173

SEQ ID NO: 204868 - RNA, 1410 nt, Artificial Sequence; identical to SEQ ID NO: 199917
  derived and/or modified sequence opt5 from neuraminidase__InfluenzaA__AFF57177

SEQ ID NO: 204869 - RNA, 1410 nt, Artificial Sequence; identical to SEQ ID NO: 199917
  derived and/or modified sequence opt5 from neuraminidase__InfluenzaA__AFF57181

SEQ ID NO: 204870 - RNA, 1410 nt, Artificial Sequence; identical to SEQ ID NO: 199917
  derived and/or modified sequence opt5 from neuraminidase__InfluenzaA__AFF57185

SEQ ID NO: 204871 - RNA, 1410 nt, Artificial Sequence; identical to SEQ ID NO: 199917
  derived and/or modified sequence opt5 from neuraminidase__InfluenzaA__AFF57189

SEQ ID NO: 204872 - RNA, 1350 nt, Artificial Sequence
  derived and/or modified sequence opt5 from neuraminidase__InfluenzaA__AFF60789
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaauuuccuuacagaaaaagcuguggccagcgugaagcuggcggggaacuccucucucuguccgaucaauggaugggcugucuacagcaaagacaacuccauuagaaucggcagcaagggggauguguuuguuauucgggagcccuucaucucuugcucccaucuggaaugucgcaccuuuuuccuuacacagggagcccugcucaaugacaagcacagcaacggcaccgugaaagauagaucuccucaucggacacugauguccugccccgucggcgaggccccuagccccuauaauucucgcuuugaauccguggcuuggagcgccuccgcuugucacgacgggaccucuuggcugacgauuggaaucagcggcccugauaacggggccguugcggugcucaaguacaauggaaucauuaccgacacaaucaaauccuggagaaacaauauucugcggacccaggagagcgagugcgccugugucaacggcucuugcuucacagugaugaccgaugggccguccaacggacaggcuagccacaagaucuuuaaaauggaaaagggcaagguggucaaaucuguugagcuugacgcccccaauuaucauuacgaagaguguagcugcuauccugaugcuggcgagauuacgugugugugccgcgacaacuggcacggguccaauagacccugggugucuuucaaccaaaaucuggaauaccagaucggauauaucugcagcggcgucuuuggggauaacccucggcccaaugacggaacaggcuccugugggccggugagcucuaacggagccuacggcguuaagggcuucuccuuuaaauacgggaauggaguguggauuggccgcaccaagagcacaaacucuagauccggguucgagaugaucugggauccuaauggauggaccgaaaccgacagcuccuuuucugucaaacaggacauuguggcgaucacagauuggagcggcuauuccgggucuuucguucagcaucccgagcucacgggccuggacugcauucggccuuguuucuggguggaacuuauccgcggaagacccaaggagagcaccaucuggacauccggcagcucuauuuccuuuugcggggucaccagcgauacagugggauggucuuggcccgacggcgccgagcugccuuucaccaucgauaaauga

SEQ ID NO: 204873 - RNA, 1410 nt, Artificial Sequence
  derived and/or modified sequence opt5 from neuraminidase__InfluenzaA__AFG29043
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuagagaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 204874 - RNA, 1410 nt, Artificial Sequence; identical to SEQ ID NO: 201543
  derived and/or modified sequence opt5 from neuraminidase__InfluenzaA__AFG29045

SEQ ID NO: 204875 - RNA, 1410 nt, Artificial Sequence; identical to SEQ ID NO: 201675
  derived and/or modified sequence opt5 from neuraminidase__InfluenzaA__AFG31063

SEQ ID NO: 204876 - RNA, 1410 nt, Artificial Sequence; identical to SEQ ID NO: 199762
  derived and/or modified sequence opt5 from neuraminidase__InfluenzaA__AFG31073

SEQ ID NO: 204877 - RNA, 1410 nt, Artificial Sequence
  derived and/or modified sequence opt5 from neuraminidase__InfluenzaA__AFG31083
augaaccccaaucagaagaucauuaccaucggcagcgugugcaugacaauugggauggccaaccugauccuccaaauuggaaauaucaucuccauuuggaucucucacagcauucagcuggucaaccagaaucagaucgagacguguaaccaauccguuauuaccuacgaaaauaacacaugggugaaucagaccuaugugaacaucucuaauacaaacuucgcugccggccagagcgucguguccguuaaacuugcggggaauagcagccugugcccuguguccggaugggcuauuuacagcaaggacaacucugucagaaucggcuccaaaggggauguguuuguuauccgggagccguucauuagcuguucuccccucgaaugccgcaccuuuuuccugacacagggagcccuucugaaugacaagcauuccaacggcaccaucaaagauagaagcccuuaucggacgcucaugucuugucccauuggcgaggugccuucccccuacaacagccgcuuugaauccgucgccuggucugcuagcgccugccacgacgggaucaauuggcugaccauuggaaucuccggcccugauaacggggcuguggccgugcugaaguauaauggaaucauuacagacaccaucaagagcuggagaaacaauauucuccggacacaagagucugagugugcgugcgucaacggcuccuguuucaccguuaugacggaugggccgagcaauggacaggccucuuacaaaaucuuucgcauugaaaagggcaaaaucgugaagucuguggagaugaacgcucccaauuaucauuacgaagagugcuccuguuacccugacucuagcgagaucacaugcgucugcagagauaacuggcacggcuccaaucggcccugggugagcuucaaccagaaucuggaauaucagauuggguacaucuguucuggaauuuuuggcgacaacccucgccccaaugauaaaaccggguccugcggaccgguuagcucuaacggcgccaacggggugaagggauucuccuuuaaguauggcaauggcgucuggaucgggagaacaaaaagcauuuccucucggaacggauucgagaugaucugggacccuaauggcuggaccgggaccgauaacaauuuuagcauuaagcaagacaucgugggaaucaacgaaugguccggcuacucugggagcuucguucagcaucccgagcuuacaggccuggacuguauucgcccuugcuucuggguggaacucaucagaggacggcccaaagagaauacgauuuggaccuccggcagcucuaucuccuuuuguggggucaacagcgauacagugggauggucuuggcccgacggcgcugagcugccuuucaccauugauaaguga

SEQ ID NO: 204878 - RNA, 1410 nt, Artificial Sequence; identical to SEQ ID NO: 199762
  derived and/or modified sequence opt5 from neuraminidase__InfluenzaA__AFG31093

SEQ ID NO: 204879 - RNA, 1410 nt, Artificial Sequence; identical to SEQ ID NO: 199762
  derived and/or modified sequence opt5 from neuraminidase__InfluenzaA__AFG31103

SEQ ID NO: 204880 - RNA, 1410 nt, Artificial Sequence; identical to SEQ ID NO: 199762
  derived and/or modified sequence opt5 from neuraminidase__InfluenzaA__AFG31113

SEQ ID NO: 204881 - RNA, 1410 nt, Artificial Sequence; identical to SEQ ID NO: 199762
  derived and/or modified sequence opt5 from neuraminidase__InfluenzaA__AFG31123

SEQ ID NO: 204882 - RNA, 1410 nt, Artificial Sequence; identical to SEQ ID NO: 199762
  derived and/or modified sequence opt5 from neuraminidase__InfluenzaA__AFG31133

SEQ ID NO: 204883 - RNA, 1410 nt, Artificial Sequence; identical to SEQ ID NO: 199762
  derived and/or modified sequence opt5 from neuraminidase__InfluenzaA__AFG31143

SEQ ID NO: 204884 - RNA, 1410 nt, Artificial Sequence; identical to SEQ ID NO: 199762
  derived and/or modified sequence opt5 from neuraminidase__InfluenzaA__AFG31153

SEQ ID NO: 204885 - RNA, 1410 nt, Artificial Sequence; identical to SEQ ID NO: 199762
  derived and/or modified sequence opt5 from neuraminidase__InfluenzaA__AFG31163

SEQ ID NO: 204886 - RNA, 1410 nt, Artificial Sequence
  derived and/or modified sequence opt5 from neuraminidase__InfluenzaA__AFG31173
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccugcccaaagagaacacgaucuggaccuccgggagcucuauuuccuuuuguggaguuaauagcgacacagugggcuggucuuggcccgauggggcugagcuuccuuucaccaucgacaaguga

SEQ ID NO: 204887 - RNA, 1410 nt, Artificial Sequence; identical to SEQ ID NO: 204886
  derived and/or modified sequence opt5 from neuraminidase__InfluenzaA__AFG31183

SEQ ID NO: 204888 - RNA, 1410 nt, Artificial Sequence; identical to SEQ ID NO: 199762
  derived and/or modified sequence opt5 from neuraminidase__InfluenzaA__AFG31193

SEQ ID NO: 204889 - RNA, 1410 nt, Artificial Sequence; identical to SEQ ID NO: 199762
  derived and/or modified sequence opt5 from neuraminidase__InfluenzaA__AFG31203

SEQ ID NO: 204890 - RNA, 1410 nt, Artificial Sequence; identical to SEQ ID NO: 199762
  derived and/or modified sequence opt5 from neuraminidase__InfluenzaA__AFG31213

SEQ ID NO: 204891 - RNA, 1410 nt, Artificial Sequence; identical to SEQ ID NO: 199762
  derived and/or modified sequence opt5 from neuraminidase__InfluenzaA__AFG31223

SEQ ID NO: 204892 - RNA, 1410 nt, Artificial Sequence; identical to SEQ ID NO: 199762
  derived and/or modified sequence opt5 from neuraminidase__InfluenzaA__AFG31233

SEQ ID NO: 204893 - RNA, 1410 nt, Artificial Sequence
  derived and/or modified sequence opt5 from neuraminidase__InfluenzaA__AFG31243
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucguggcugggcagagcgucguguccguuaaacuugccggaaauucuagccugugcccuguguccggcugggcgauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggcuuggucugccagcgcuugccacgacggaauuaauuggcugaccaucggcaucuccgggccugauaacggagccgucgcugugcugaaguauaauggcauuaucacagacaccauuaagagcuggagaaacaauauccuccggacacaagagucugagugugccugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucgucggcauuaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggccgagcugccuuucaccaucgacaaguga

SEQ ID NO: 204894 - RNA, 1410 nt, Artificial Sequence; identical to SEQ ID NO: 202754
  derived and/or modified sequence opt5 from neuraminidase__InfluenzaA__AFG31253

SEQ ID NO: 204895 - RNA, 1410 nt, Artificial Sequence; identical to SEQ ID NO: 199762
  derived and/or modified sequence opt5 from neuraminidase__InfluenzaA__AFG31263

SEQ ID NO: 204896 - RNA, 1410 nt, Artificial Sequence; identical to SEQ ID NO: 199762
  derived and/or modified sequence opt5 from neuraminidase__InfluenzaA__AFG31273

SEQ ID NO: 204897 - RNA, 1410 nt, Artificial Sequence; identical to SEQ ID NO: 199762
  derived and/or modified sequence opt5 from neuraminidase__InfluenzaA__AFG31283

SEQ ID NO: 204898 - RNA, 1410 nt, Artificial Sequence; identical to SEQ ID NO: 199762
  derived and/or modified sequence opt5 from neuraminidase__InfluenzaA__AFG31293

SEQ ID NO: 204899 - RNA, 1410 nt, Artificial Sequence; identical to SEQ ID NO: 199762
  derived and/or modified sequence opt5 from neuraminidase__InfluenzaA__AFG31303

SEQ ID NO: 204900 - RNA, 1410 nt, Artificial Sequence; identical to SEQ ID NO: 199762
  derived and/or modified sequence opt5 from neuraminidase__InfluenzaA__AFG31313

SEQ ID NO: 204901 - RNA, 1410 nt, Artificial Sequence; identical to SEQ ID NO: 199762
  derived and/or modified sequence opt5 from neuraminidase__InfluenzaA__AFG31326

SEQ ID NO: 204902 - RNA, 1410 nt, Artificial Sequence; identical to SEQ ID NO: 199762
  derived and/or modified sequence opt5 from neuraminidase__InfluenzaA__AFG31336

SEQ ID NO: 204903 - RNA, 1410 nt, Artificial Sequence; identical to SEQ ID NO: 202754
  derived and/or modified sequence opt5 from neuraminidase__InfluenzaA__AFG31346

SEQ ID NO: 204904 - RNA, 1410 nt, Artificial Sequence; identical to SEQ ID NO: 202754
  derived and/or modified sequence opt5 from neuraminidase__InfluenzaA__AFG31356

SEQ ID NO: 204905 - RNA, 1410 nt, Artificial Sequence; identical to SEQ ID NO: 202754
  derived and/or modified sequence opt5 from neuraminidase__InfluenzaA__AFG31366

SEQ ID NO: 204906 - RNA, 1410 nt, Artificial Sequence; identical to SEQ ID NO: 202754
  derived and/or modified sequence opt5 from neuraminidase__InfluenzaA__AFG31379

SEQ ID NO: 204907 - RNA, 1410 nt, Artificial Sequence; identical to SEQ ID NO: 202754
  derived and/or modified sequence opt5 from neuraminidase__InfluenzaA__AFG31389

SEQ ID NO: 204908 - RNA, 1410 nt, Artificial Sequence; identical to SEQ ID NO: 202754
  derived and/or modified sequence opt5 from neuraminidase__InfluenzaA__AFG31399

SEQ ID NO: 204909 - RNA, 1410 nt, Artificial Sequence; identical to SEQ ID NO: 202754
  derived and/or modified sequence opt5 from neuraminidase__InfluenzaA__AFG31409

SEQ ID NO: 204910 - RNA, 1410 nt, Artificial Sequence; identical to SEQ ID NO: 199762
  derived and/or modified sequence opt5 from neuraminidase__InfluenzaA__AFG31419

SEQ ID NO: 204911 - RNA, 1410 nt, Artificial Sequence; identical to SEQ ID NO: 199762
  derived and/or modified sequence opt5 from neuraminidase__InfluenzaA__AFG31429

SEQ ID NO: 204912 - RNA, 1410 nt, Artificial Sequence; identical to SEQ ID NO: 199762
  derived and/or modified sequence opt5 from neuraminidase__InfluenzaA__AFG31439

SEQ ID NO: 204913 - RNA, 1410 nt, Artificial Sequence; identical to SEQ ID NO: 199762
  derived and/or modified sequence opt5 from neuraminidase__InfluenzaA__AFG31449

SEQ ID NO: 204914 - RNA, 1410 nt, Artificial Sequence; identical to SEQ ID NO: 199762
  derived and/or modified sequence opt5 from neuraminidase__InfluenzaA__AFG31459

SEQ ID NO: 204915 - RNA, 1410 nt, Artificial Sequence; identical to SEQ ID NO: 199762
  derived and/or modified sequence opt5 from neuraminidase__InfluenzaA__AFG31469

SEQ ID NO: 204916 - RNA, 1410 nt, Artificial Sequence; identical to SEQ ID NO: 199762
  derived and/or modified sequence opt5 from neuraminidase__InfluenzaA__AFG31479

SEQ ID NO: 204917 - RNA, 1410 nt, Artificial Sequence; identical to SEQ ID NO: 199762
  derived and/or modified sequence opt5 from neuraminidase__InfluenzaA__AFG31499

SEQ ID NO: 204918 - RNA, 1410 nt, Artificial Sequence; identical to SEQ ID NO: 201653
  derived and/or modified sequence opt5 from neuraminidase__InfluenzaA__AFG31509

SEQ ID NO: 204919 - RNA, 1410 nt, Artificial Sequence; identical to SEQ ID NO: 202754
  derived and/or modified sequence opt5 from neuraminidase__InfluenzaA__AFG31519

SEQ ID NO: 204920 - RNA, 1410 nt, Artificial Sequence; identical to SEQ ID NO: 199762
  derived and/or modified sequence opt5 from neuraminidase__InfluenzaA__AFG31529

SEQ ID NO: 204921 - RNA, 1410 nt, Artificial Sequence; identical to SEQ ID NO: 201653
  derived and/or modified sequence opt5 from neuraminidase__InfluenzaA__AFG31539

SEQ ID NO: 204922 - RNA, 1410 nt, Artificial Sequence; identical to SEQ ID NO: 199762
  derived and/or modified sequence opt5 from neuraminidase__InfluenzaA__AFG31549

SEQ ID NO: 204923 - RNA, 1410 nt, Artificial Sequence; identical to SEQ ID NO: 199762
  derived and/or modified sequence opt5 from neuraminidase__InfluenzaA__AFG31559

SEQ ID NO: 204924 - RNA, 1410 nt, Artificial Sequence; identical to SEQ ID NO: 202754
  derived and/or modified sequence opt5 from neuraminidase__InfluenzaA__AFG31569

SEQ ID NO: 204925 - RNA, 1410 nt, Artificial Sequence; identical to SEQ ID NO: 199762
  derived and/or modified sequence opt5 from neuraminidase__InfluenzaA__AFG31579

SEQ ID NO: 204926 - RNA, 1410 nt, Artificial Sequence; identical to SEQ ID NO: 199762
  derived and/or modified sequence opt5 from neuraminidase__InfluenzaA__AFG31589

SEQ ID NO: 204927 - RNA, 1410 nt, Artificial Sequence; identical to SEQ ID NO: 199762
  derived and/or modified sequence opt5 from neuraminidase__InfluenzaA__AFG31599

SEQ ID NO: 204928 - RNA, 1410 nt, Artificial Sequence; identical to SEQ ID NO: 199762
  derived and/or modified sequence opt5 from neuraminidase__InfluenzaA__AFG31609

SEQ ID NO: 204929 - RNA, 1410 nt, Artificial Sequence; identical to SEQ ID NO: 199762
  derived and/or modified sequence opt5 from neuraminidase__InfluenzaA__AFG31619

SEQ ID NO: 204930 - RNA, 1410 nt, Artificial Sequence; identical to SEQ ID NO: 199762
  derived and/or modified sequence opt5 from neuraminidase__InfluenzaA__AFG31629

SEQ ID NO: 204931 - RNA, 1410 nt, Artificial Sequence; identical to SEQ ID NO: 202754
  derived and/or modified sequence opt5 from neuraminidase__InfluenzaA__AFG31639

SEQ ID NO: 204932 - RNA, 1410 nt, Artificial Sequence; identical to SEQ ID NO: 199762
  derived and/or modified sequence opt5 from neuraminidase__InfluenzaA__AFG31649

SEQ ID NO: 204933 - RNA, 1410 nt, Artificial Sequence; identical to SEQ ID NO: 199762
  derived and/or modified sequence opt5 from neuraminidase__InfluenzaA__AFG31659

SEQ ID NO: 204934 - RNA, 1410 nt, Artificial Sequence; identical to SEQ ID NO: 199762
  derived and/or modified sequence opt5 from neuraminidase__InfluenzaA__AFG31669

SEQ ID NO: 204935 - RNA, 1410 nt, Artificial Sequence; identical to SEQ ID NO: 197119
  derived and/or modified sequence opt5 from neuraminidase__InfluenzaA__AFG71868

SEQ ID NO: 204936 - RNA, 1410 nt, Artificial Sequence; identical to SEQ ID NO: 197119
  derived and/or modified sequence opt5 from neuraminidase__InfluenzaA__AFG71890

SEQ ID NO: 204937 - RNA, 1410 nt, Artificial Sequence; identical to SEQ ID NO: 197119
  derived and/or modified sequence opt5 from neuraminidase__InfluenzaA__AFG71901

SEQ ID NO: 204938 - RNA, 1410 nt, Artificial Sequence; identical to SEQ ID NO: 197138
  derived and/or modified sequence opt5 from neuraminidase__InfluenzaA__AFG71912

SEQ ID NO: 204939 - RNA, 1410 nt, Artificial Sequence
  derived and/or modified sequence opt5 from neuraminidase__InfluenzaA__AFG71934
augaaccccaaucagaagaucauuaccaucggcagcgugucccugacaauugccacggucugcuuccucaugcaaaucgcuauucugaucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaucccgcaucgcacccuccugaugaacgaacugggggugcccuuucaccucggaacgagacaggucuguauugccuggagcuccagcucuugccaugauggcaaggcuuggcugcacguguguguuacaggcgacgauaaaaaugccaccgcuuccuucaucuaugacgggcggcuuguggauagcauuggaucuuggucccagaacauccugcgcacacaagagagcgaaugcgucuguaucaauggaaccugcaccguggugaugacagacgggucugccuccggcagagcggauacgcggauucucuuuaucgaggagggcaagauuguccacaucagcccucuguccgggucugcccagcauguugaagagugcagcuguuacccccgcuauccuggagugagaugcauuugucgggacaacuggaaaggcuccaaucgccccguggucgacaucaacgugaaggauuacagcaucgacucuagauacguuugcuccggccuugugggggauaccccgcggaacaaugaccgcuucagcaacucuaauuguagaaacccuaauaacgaacggggaaaucacggcgucaaggggugggcuuuugaugacggaaacgauguguggaugggcagaacaauuagcaaagacucccgcucuggguaugagaccuucaagguuaucggaggcuggagcacacccaauuccaaaagccagauuaacagacaggugaucgucgauucugacaaucgguccggcuacagcgggaucuuuucuguggaaggaaaguccugcauuaaccgcuguuucuaugucgagcugauucggggcagagagcaagaaacccgcgugugguggacgagcaauuccaucguuguguuuugcgggacaucuggaaccuacggcaccgggagcuggccugauggcgccgacaucaaccucaugcccauuuga

SEQ ID NO: 204940 - RNA, 1410 nt, Artificial Sequence
  derived and/or modified sequence opt5 from neuraminidase__InfluenzaA__AFG71945
augaaccccaaucagaagaucauuaccaucggcagcgugucccugacaauugccacggucugcuuccucaugcaaaucgcuauucugguuaccacagugacccuucacuuuaaacaguacgagugugacucuccugccaacaaucaggugaugccgugcgaacccaucaucauugagagaaacaucacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggauuccgcaucgcacccuccugaugaacgaacuggggguccccuuucaccucggaacgagacagguguguaucgccuggagcuccagcucuugccaugauggcaaggcuuggcugcacguuugugugacaggcgacgaugagaaugccaccgcuuccuucauuuaugacgggcggcuugucgauagcaucggaucuuggucccagaacauucugcgcacacaagaaagcgagugcguguguaucaauggaaccugcaccguggucaugacagacgggucugccuccggcagagcggauacgcggauccucuuuauugaggaaggcaaaaucguucacauuagcccucuguccgggucugcccagcauguggaggaaugcagcuguuacccccgcuauccuggagugagaugcaucugucgggacaacuggaagggcuccaaucgccccgucguggacauuaacguuaaagauuacagcaucgacucuagauacgugugcuccggccuugucggggauaccccgcggaacaaugacaagagcucuaacagcaauugucgcaacccuaauaacgauaagggaaaucacggcgugaaagggugggcuuucgacgauggaaacgacguuuggaugggcagaacaaucuccaaggauucucggagcggguaugagaccuuuaaagugauuggaggcugguccacacccaauagcaagucucagaucaacagacaggucauuguggacuccgauaaucgcagcggcuacucugggaucuucuccgucgaaggaaaaagcugcauuaaccgguguuuuuauguggagcugaucagaggccgcgagcaagaaaccaagguuugguggacguccaauucuauuguggucuucugcgggacaagcggaaccuacggcaccggguccuggccugacggcgccgacaucaaccucaugucuaucuga

SEQ ID NO: 204941 - RNA, 1410 nt, Artificial Sequence; identical to SEQ ID NO: 197142
  derived and/or modified sequence opt5 from neuraminidase__InfluenzaA__AFG71967

SEQ ID NO: 204942 - RNA, 1410 nt, Artificial Sequence; identical to SEQ ID NO: 197142
  derived and/or modified sequence opt5 from neuraminidase__InfluenzaA__AFG71978

SEQ ID NO: 204943 - RNA, 1410 nt, Artificial Sequence
  derived and/or modified sequence opt5 from neuraminidase__InfluenzaA__AFG71988
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcaucuguaucaauggaaccugcacagucgugaugacggaugggucugccuccggcagagcggacaccaagauucucuuuaucgaggagggcaaaauugugcacaucagcccucuguccgggucugcccagcaugucgaagagugcagcuguuauccccgguacccuggaguucgcugcauuuguagagauaacuggaagggcuccaaucggcccgugguggacaucaacgucaaggacuacagcaucgauucuuccuaugugugcagcggccuuguuggggacacaccgcgcaacaaugauagaucuagcaacuccuacugucggaauccuaacaaugaaaaaggaaaccacggcgugaaggggugggcuuucgacgauggaaaugacgucuggaugggccgcaccauuucugaggauagcagauccggguaugaaacauuuaaagugaucggaggcuggagcacccccaacucuaagcugcagauuaaucggcagguuaucguggacuccgauaacagaagcggcuacucugggauuuucuccgucgagggaaaaagcugcaucaaucgcuguuuuuauguggagcucauucggggcagagaacaagagacgcgcgucugguggacauccaacucuaucgugguuuucugcgggaccagcggaaccuacggcacaggguccuggccugacggcgccgauaucaaucugaugcccauuuga

SEQ ID NO: 204944 - RNA, 1410 nt, Artificial Sequence; identical to SEQ ID NO: 197142
  derived and/or modified sequence opt5 from neuraminidase__InfluenzaA__AFG71999

SEQ ID NO: 204945 - RNA, 1410 nt, Artificial Sequence; identical to SEQ ID NO: 197600
  derived and/or modified sequence opt5 from neuraminidase__InfluenzaA__AFG72021

SEQ ID NO: 204946 - RNA, 1410 nt, Artificial Sequence
  derived and/or modified sequence opt5 from neuraminidase__InfluenzaA__AFG72032
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacccccuaucgcacgcuccugaugaacgaacugggggugccuuuucaucucggaacaagacaggucuguaucgccugguccuccucuuccugccacgacggcaaggccuggcugcauguguguguuaccggcuacgauaaaaaugcuacagccagcuucauuuaugacgggcggcuuguggauucuaucggauccuggagcaagaacauucugcgcacccaggagucugaaugcgucuguaucaaugggaccugcacaguggugaugacggacggcuccgcuagcgagagagccgauaccaaaauccucuuuauugaggaaggaaagaucguccacauuagcccccugucuggcagcgcgcaacacguugaggaaugcuccuguuacccucgguaccccggggugcgcugcguguguagagacaacuggaagggaagcaaucggccggucguggauaucaacguuaaagacuauucuauuguguccagcuacgucugcucuggccuugugggcgacacaccucgcaagaacgauagaagcuccucuagcuauugucggaaucccaacaaugagaaagggaaccauggaguuaagggcugggccuucgacgaugggaaugacguguggaugggacgcaccaucuccgaagagagcagaucuggcuacgagacauuuaaagucaucgggggaugguccaccccuaacagcaagcugcagauuaauagacaggugaucgucgauucugacaaccgguccggcuauagcggcauuuucuccguggaagggaaaucuugcaucaaucgcuguuuuuacguugagcucauucggggaagagaacaggagacgcgcgugugguggacaagcaacuccaucgucguguucugcggcaccucugggaccuauggaacaggcagcuggcccgauggggcugacauuaaucugaugcccaucuga

SEQ ID NO: 204947 - RNA, 1410 nt, Artificial Sequence; identical to SEQ ID NO: 197837
  derived and/or modified sequence opt5 from neuraminidase__InfluenzaA__AFG72088

SEQ ID NO: 204948 - RNA, 1410 nt, Artificial Sequence
  derived and/or modified sequence opt5 from neuraminidase__InfluenzaA__AFG72121
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaauagagugaugcccugcgaaccuacaaucauugagcggaacaucaccgaaauuguguaucugacaaauaccacgaucgagaaggaaauuugucccaaacucgucgaguaccgcaacugguccaagccucagugcaaaaucaccggguucgcccccuuuucuaaggacaauagcauuagacuguccgcgggaggcgauaucugggugacacgggagccuuauguuucuugugacccggggaagugcuaccaguucgcucuuggacaaggcaccacacugaacaaucgccauagcaacgauaccgugcacgacagaacgcccuaucggacacuccugaugaaugaacugggggucccuuuucaucucggaaccaaacagguguguauggccugguccuccucuuccugccacgauggcaaggccuggcugcauguuugugugacaggccacgacgagaacgcuaccgccagcuucaucuacgaugggcgccuugucgacucuauuggauccuggagcaaaaauauccugagaacccaggaaucugagugcguguguauuaacggcacaugcacgguggucaugaccgauggguccgcuagcgagcgggccgacacaaagauccucuuuauugaagagggaaaaaucguucacaucagcccccugucuggcagcgcgcagcauguggaagagugcuccuguuauccucgcuaccccggggugagaugcgucugucgggauaauuggaagggaagcaaccgcccgauuguggacaucaacguuaaggauuacucuauuguguccagcuaugucugcucuggccuugugggcgacaccccucggaaaaaugacagaagcuccucuagcuacugucgcaaccccaauaacgaaaaggggucccacggaguuaaaggcugggccuucgaugacgggaaugauguguggaugggaagaacaaucggcgaggagcugcggagcggguaugaaaccuuuaaggucauuggaggcuggucuacgccuaacuccaaacuccaaaucaauagacaggugaucgucgacagcggcaaccgcucuggguacuccggaauuuucagcguggagggcaaguccugcaucaaucgguguuuuuauguugaacugauuagagggcgcaaacaggagacacgggugugguggaccucuaacagcaucgucguguucugcggaaccuccggcacauacgggaccggcucuuggcccgauggagcugacauuaaucugaugcccaucuga

SEQ ID NO: 204949 - RNA, 1410 nt, Artificial Sequence
  derived and/or modified sequence opt5 from neuraminidase__InfluenzaA__AFG72143
augaaccccaaucagaagaucauuaccaucggcagcgugucccugacaauugccacgaucugccuccugaugcaaauugcuauccuugucaccacaguuacccugcacuucaaacaguacgaguguucuagcccuccgaacaaucaggugaugcccugcgaaccuacaaucauugagagaaacaucaccgaaauuguguaucucacaaauaccacgaucgagaaggaaauuugucccaaacuggucgaguaccggaacugguccaagccucagugcaaaaucaccggguuugcccccuucucuaaggacaauagcauucgccuuuccgcgggaggcgauaucugggugacaagagagccuuauguuucuugugacccggggaagugcuaccaauuugcucugggacagggcaccacacucaacaaucggcauagcaacgauaccgugcacgaccgcacgcccuauagaacacugcugaugaaugaacucggggucccuuuccaucugggaaccaaacagguguguaucgccugguccuccucuuccugccacgauggcaaggccuggcuucauguuugugugacaggccacgacgagaacgcuaccgccagcuuuauuuacgaugggcggcuggucgacucuaucggauccuggagcaaaaauauucuccgcacccaggaaucugagugcguguguaucaacggcacaugcacgguggucaugaccgauggguccgcuagcgagagagccgacacaaagauucuguucaucgaagagggaaaaaucguucacauuagcccccuuucuggcagcgcgcaacauguggaagagugcuccuguuauccucgguaccccggggugcgcugcgucuguagagauaauuggaagggaagcaaccggccgaucguggacauuaacguuaaggauuacucuaucguguccagcuaugucugcucuggccuggugggcgacaccccucgcaaaaaugacagcuccucuagcuccuacuguagaaaccccaauaacgaaaaggggagccacggaguuaaaggcugggccuuugaugacgggaaugauguguggaugggacggacaauuggcgaggagcuccgcucuggguaugaaaccuucaaggucaucggaggcugguccacgccuaacagcaaacugcagaucaauagacaggugauugucgacucuggcaaccgguccggguacagcggaaucuuuuccguggagggcaagucuugcauuaauagauguuucuauguugaacugauccgcgggcggaaacaggagacaaaggugugguggaccagcaacuccauugucguguuuugcggaaccucuggcacauacgggaccggcagcuggcccgauggagcugacaucaaucucaugcccauuuga

SEQ ID NO: 204950 - RNA, 1410 nt, Artificial Sequence
  derived and/or modified sequence opt5 from neuraminidase__InfluenzaA__AFG72165
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcccugcgaaccuacaaucauugagagaaauaucaccgaaauuguguaucugacaaacaccacgaucgagaaggaaauuugucccaaacucgucgaguaccggaauuggagcaagccucagugcaaaaucaccggguucgcccccuuuuccaaggacaacucuauucgccugagcgcgggaggcgauaucugggugacaagagagccuuauguuuccugugacccggggaagugcuaccaauucgcucuuggacagggcaccacacugaauaaccggcauucuaaugauaccgugcacgaccgcacgcccuauagaacacuccugaugaacgaacugggggucccuuuucaucucggaaccaaacagguguguaucgccuggagcuccagcucuugccacgauggcaaggccuggcugcauguuugugugacaggccacgacgagaaugcuaccgccuccuucauuuacgaugggcggcuugucgacagcaucgugucuugguccaaaaacauucugcgcacccaggaaagcgagugcguguguaucaauggaacaugcacggucguuaugaccgauggcucugcuuccgagagagccgacacaaagauucucuuuaucgaagaggggaaaaucgugcacauuagcccccuguccggaucugcgcaacauguggaagagugcagcuguuauccucgguaccccggcguccgcugcguguguagagauaacuggaagggguccaaccggccgaucguugacauuaaugugaaggauuacagcaucgucucuuccuaugugugcagcggacuuguuggcgacaccccucgcaaaaacgacucuagcuccucuagcuacuguagaaaucccaacaaugaaaagggcucccacggggugaaaggaugggccuucgaugacggcaacgaugucuggauggggcggacaauuggagaggagcugcgcagcggcuaugaaaccuuuaaggugaucgggggauggucuacgccuaauuccaaacuccagacaaacagacaggucaucguggaccggggcaauagaagcggcuacucugggauuuucuccguugagggaaagagcugcaucaaccgcuguuuuuauguggaacugauucggggcagaaaacaggagaccaaggucugguggaccuccaauucuaucgugguuuucugcgggacaagcggaaccuacggcacaggguccuggcccgauggcgcugacauuaaccugaugcccaucuga

SEQ ID NO: 204951 - RNA, 1410 nt, Artificial Sequence
  derived and/or modified sequence opt5 from neuraminidase__InfluenzaA__AFG72176
augaaccccaaucagaagaucauuaccaucggcagcgugucccugacaauugccacgaucugcuuccucaugcaaauuaccauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaaaauguccuaagcuggucgaguaccggaauuggagcaaaccccagugcaagauuacaggguucgcuccuuuuuccaaggacaacucuauccgccuuagcgccggaggcgauauuugggugaccagagagcccuauguuuccugugacccugggaaaugcuaccaauucgcgcugggacagggcacaacccucaauaaccggcauucuaaugauacggugcacgaccgcacaccguauagaacccugcugaugaacgaacucgggguccccuuucaucugggaacaaaacagguguguaucgcuuggagcuccagcucuugccacgauggcaaggccuggcuucauguuugugugaccggccacgacgagaaugccaccgcuuccuucaucuacgaugggcggcuggucgacagcauuggaucuugguccaagaacauccuccgcacacaggaaagcgagugcguguguauuaauggcacgugcaccguggucaugacagaugggucugccuccgagagagcugacaccaaaauccuguuuauugaagagggaaagaucguucacaucagcccucuuuccggcucugcccaacauguggaagagugcagcuguuauccccgguacccuggggugcgcugcgucuguagagauaacuggaagggauccaaccggcccauuguggacaucaauguuaaagauuacagcauugugucuuccuaugucugcagcggccuggugggcgacacaccgcgcaagaacgacucuagcuccucuagcuacuguagaaauccuaacaaugaaaaagggucccacggaguuaagggcugggcguucgaugacgggaacgauguguggaugggacggaccaucagcgaggagcuccgcucuggcuaugaaacguuuaaagucauugggggaugguccacacccaauagcaagcugcagaucaacagacaggugaucgucgaccggggcaauagaucuggcuacuccgggauuuucagcguggagggaaaauccugcaucaaccgcuguuuuuauguugaacugauucggggcagaaagcaggagaauaaggugugguggaccucuaacagcaucgucguguucugcgggaccuccggaacauacggcaccgggucuuggccugauggcgccgacauuaaucucaugcccaucuga

SEQ ID NO: 204952 - RNA, 1410 nt, Artificial Sequence; identical to SEQ ID NO: 204950
  derived and/or modified sequence opt5 from neuraminidase__InfluenzaA__AFG72198

SEQ ID NO: 204953 - RNA, 1410 nt, Artificial Sequence; identical to SEQ ID NO: 204950
  derived and/or modified sequence opt5 from neuraminidase__InfluenzaA__AFG72209

SEQ ID NO: 204954 - RNA, 1410 nt, Artificial Sequence
  derived and/or modified sequence opt5 from neuraminidase__InfluenzaA__AFG72220
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauugugcaucucacaaacaccacgaucgagaaggaaauuuguccuaaacuggccgaguaucggaauuggagcaagccccagugcaaaaucaccggguucgcgccuuuuuccaaggacaacucuauucgccuuagcgcuggaggcgauaucugggucacaagagagcccuacguguccugugacccugggaagugcuaucaauucgcccugggacagggcaccacacucaauaaccggcacucuaaugauaccguucaugaccgcacgccguacagaacacugcugaugaacgaacucggggugcccuuucaccugggaaccaaacaggucuguaucgccuggagcuccagcucuugccaugauggcaaggcuuggcuucacguguguguuacaggccacgacgagaaugccaccgcuuccuucauuuaugaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccauauuagcccucuuuccggcucugcccaacacguugaagagugcagcuguuacccccgguauccuggggugcgcugcguguguagagauaacuggaagggauccaaccggcccaucgucgacauuaaugugaaggauuacagcaucguuucuuccuacgugugcagcggccuggucggcgacaccccgcgcaaaaacgacucuagcuccucuagcuauuguagaaauccuaacaaugaaaaggggucccauggagugaaaggcugggcuuucgaugacgggaacgauguuuggaugggacggacaauuagcgaggagcuccgcucuggcuacgaaaccuuuaaggugaucgggggaugguccaaacccaauagcaagcugcagaucaacagacaggucauuguggaccggggcaauagaucuggcuauuccgggaucuucagcgucgagggaaaauccugcauuaaccgcuguuuuuacguggaacugauccggggcagaaagcaggagacggaaguuugguggacaucuaauagcauuguggucuucugcgggaccuccggaaccuauggcacagggucuuggccugauggcgccgacaucaaccucaugcccauuuga

SEQ ID NO: 204955 - RNA, 1410 nt, Artificial Sequence; identical to SEQ ID NO: 204950
  derived and/or modified sequence opt5 from neuraminidase__InfluenzaA__AFG72231

SEQ ID NO: 204956 - RNA, 1410 nt, Artificial Sequence
  derived and/or modified sequence opt5 from neuraminidase__InfluenzaA__AFG72297
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagcgggaaauuuguccuaagcuggccgaguaccgcaauuggagcaaaccccagugcaagaucaccggguucgcgccuuuuuccaaagacaacucuauuagacuuagcgcuggaggcgauaucugggucacacgggagcccuauguguccugugacccugggaagugcuaccaauucgcccugggacagggcaccacacucaauaaccgccauucuaaugauaccguucacgaaagaacgccguaucggacacugcugaugaacgagcucggggugcccuuucaucugggaaccaagcaggucuguaucgccuggagcuccagcucuugccacgacggcaaggcuuggcuucauguguguguuacaggccacgaugaaaaugccaccgcuuccuucauuuacgacgggcgccugguggauagcaucggaucuugguccaaaaacauucucagaacccaggagagcgagugcgucuguaucaauggcacaugcacgguggugaugaccgacgggucugccuccgaacgggcggauacaaaaauucuguuuaucgaggaaggaaagaucguccacauuagcccucuuuccggcucugcccaacauguugaggaaugcagcuguuauccccgcuacccuggggugagaugcgugugucgggacaacuggaaaggauccaaccgccccaucgucgauauuaaugugaaggacuacagcaucguuucuuccuaugugugcagcggccuggucggcgauaccccgagaaagaacgacucuagcuccucuagcuacugucggaauccuaacaaugagaaagggucccacggagugaagggcugggcuuucgacgaugggaacgacguuuggaugggacgcacaauuagcgaggaacucagaucuggcuaugagaccuuuaaagugaucgggggaugguccaagcccaauagcaaacugcagaucaaccggcaggucauuguggauagaggcaaucgcucuggcuacuccgggaucuucagcgucgaaggaaaguccugcauuaaccgguguuuuuauguggagcugaucagaggccgcaaacaggaaacggagguuugguggacaucuaauagcauuguggucuucugcgggaccuccggaaccuacggcacagggucuuggccugacggcgccgauaucaaccucaugcccauuuga

SEQ ID NO: 204957 - RNA, 1410 nt, Artificial Sequence
  derived and/or modified sequence opt5 from neuraminidase__InfluenzaA__AFG72308
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacuguagaaacccuaauaacgaaaaggggagccacggagugaaaggcugggcuuucgaugacgggaaugauguuuggaugggacggacaauuucugaggagcuccgcuccggcuaugaaaccuuuagagugaucgggggauggagcaagcccaacucuaaacugcagaucaaucggcaggucauuguggacagaggcaaccgcuccggcuacagcgggaucuucuccgucgagggaaagucuugcauuaaucgguguuuuuauguggaacugaucagaggccgcaaacaggagacggaaguuugguggacaagcaacuccauuguggucuucugcgggaccucuggaaccuacggcacagggagcuggccugauggcgccgacaucaaucucaugcccauuuga

SEQ ID NO: 204958 - RNA, 1410 nt, Artificial Sequence; identical to SEQ ID NO: 198209
  derived and/or modified sequence opt5 from neuraminidase__InfluenzaA__AFG72320

SEQ ID NO: 204959 - RNA, 1410 nt, Artificial Sequence
  derived and/or modified sequence opt5 from neuraminidase__InfluenzaA__AFG72331
augaaccccaaucagaagaucauuaccaucggcagcgugucccugacagucgccacgauuugcuuccucaugcaaaucgcuauucugguuaccacagugacccuucacuuuaaacaguacgaguguaacucuccuccgaauaaccaggugaugcugugcgaacccacaaucaucgagagaaauauuaccgaaaucgucuaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauauuugggugacaagagagcccuauguuuccugugacccugggaagugcuaccaauucgcccugggacagggcaccacacucaauaaccggcauucuaaugauaccgugcacgaccgcacgccguauagaacacugcugaugaacgaacucgggguccccuuucaucugggaaccaaacagguguguaucgccuggagcuccagcucuugccacgauggcaaggcuuggcuucauguuugugugacaggccacgacgagaaugccaccgcuuccuucaucuacgaugggcggcuggucgacagcauuggaucuugguccaaaaacauccuccgcacccaggaaagcgagugcguguguauuaauggcacaugcacgguggucaugaccgaugggucugccuccgagagagcggacacaaagauccuguuuauugaagagggaaaaaucguucacaucagcccucuuuccggcucugcccaacauguggaagagugcagcuguuauccccgguacccuggggugcgcugcgucuguagagauaacuggaagggauccaaccggcccauuguggacaucaauguuaaggauuacagcauugugucuuccuaugucugcagcggccuggugggcgacaccccgcgcaaaaacgacucuagcuccucuagcuacuguagaaauccuaacaaugaaaaggggucccacggaguuaaaggcugggcuuucgaugacgggaacgauguguggaugggacggacaaucagcgaggagcuccgcucuggcuaugaaaccuuuaaggucauugggggaugguccaaacccaauagcaagcugcagaucaacagacaggugaucgucgaccggggcaauagaucuggcuacuccgggauuuucagcguggagggaaaauccugcaucaaccgcuguuuuuauguugaacugauucggggcagaaagcaggagacggaagugugguggacaucuaauagcaucgucguguucugcgggaccuccggaaccuacggcacagggucuuggccugauggcgccgacauuaaccucaugcccaucuga

SEQ ID NO: 204960 - RNA, 1410 nt, Artificial Sequence
  derived and/or modified sequence opt5 from neuraminidase__InfluenzaA__AFG72353
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacucugggaagugcuaccaauucgcccugggacagggcaccacacucaauaaccggcauagcaaugauaccguucacgaccgcacgccuuauagaacacugcugaugaacgaacucggggugccguuucaucugggaaccaaacaggucuguaucgccugguccuccucuuccugccacgauggcaaggcuuggcuucauguguguguuacaggccacgacgagaaugccaccgcuagcuucauuuacgaugggcggcugguggacucuaucggauccuggagcaaaaacauucuccgcacccaggaaucugagugcgucuguaucaauggcacaugcacgguggugaugaccgauggguccgccagcgagagagcggacacaaagauucuguuuaucgaagagggaaaaaucguccacauuagcccccuuucuggcagcgcccaacauguugaagagugcuccuguuauccucgguaccccggggugcgcugcguguguagagauaacuggaagggaagcaaccggccuaucgucgacauuaaugugaaggauuacucuaucguuuccagcuaugugugcucuggccuggucggcgacacaccccgcaaaaacgacagcuccucuagcuccuacuguagaaauccgaacaaugaaaaggggagccacggagugaaaggcugggcuuucgaugacgggaacgauguuuggaugggacggaccauuucugaggagcuccgcuccggcuaugaaaccuuuaaggugaucgggggauggagcaaaccuaauucuaagcugcagaucaacagacaggucauuguggaccggggcaauagauccggcuacagcgggaucuucuccgucgagggaaaaucuugcauuaaccgcuguuuuuauguggaacugauccggggcagaaagcaggagacggaaguuugguggacaagcaauuccauuguggucuucugcgggaccucuggaaccuacggcacagggagcuggcccgauggcgccgacaucaaccucaugccuauuuga

SEQ ID NO: 204961 - RNA, 1410 nt, Artificial Sequence; identical to SEQ ID NO: 198209
  derived and/or modified sequence opt5 from neuraminidase__InfluenzaA__AFG72364

SEQ ID NO: 204962 - RNA, 1410 nt, Artificial Sequence
  derived and/or modified sequence opt5 from neuraminidase__InfluenzaA__AFG72430
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccggcagagccgauacaaagauccuguuuaucgaggaaggaaaaauuguccacaucagccaacuuuccgggucugcgcagcauguugaggaauguagcugcuacccucgguaucccggagugcgcugugugugcagagacaacuggaagggcuccaaucggccuauugucgauaucaacgugaaggacuacagcauuguuucuuccuacguguguagcggccuggucggggauacaccccgcaaaaaugacucuagcuccucuagcaacugccucgacccgaauaacgaggaaggaggccacggggugaagggaugggccuucgaugacggcaaugauguuuggauggggagaaccaucuccgagaaacugcggagcggauaugagaccuuuaaggugaucggcggcuggucuaaaccuaacuccaagcugcagauuaaucgccaggucaucguggacagagggaaccggagcggauacucuggcauuuucuccgucgaagggaaaagcuguaucaauagaugcuuuuauguggagcucauucgcggacggaagcaagaaacggagguuugguggacauccaacucuaucguggucuucuguggcaccagcgggaccuacggcacaggauccuggcccgauggcgcugacauuaaucugaugccuaucuga

SEQ ID NO: 204963 - RNA, 1410 nt, Artificial Sequence; identical to SEQ ID NO: 198209
  derived and/or modified sequence opt5 from neuraminidase__InfluenzaA__AFG72452

SEQ ID NO: 204964 - RNA, 1410 nt, Artificial Sequence
  derived and/or modified sequence opt5 from neuraminidase__InfluenzaA__AFG72474
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcgagaucaccggguucgcgccuuuuuccaaagacaacucuauucgccuuagcgcuggaggcgauaucugggucacaagagaacccuauguguccugugacccugggaagugcuaccaauucgcccugggacagggcaccacacucaauaaccggcauucuaaugauaccguucacgaccgcacgccguauagaacacugcugaugaacgagcucggggugcccuuucaucugggaaccaagcaggucuguaucgccuggagcuccagcucuugccacgauggcaaggcuuggcuucauguguguguuacaggccacgacgaaaaugccaccgcuuccuucauuuacgaugggcggcugguggacagcaucggaucuugguccaaaaacauucuccgcacccaggagagcgagugcgucuguaucaauggcacaugcacgguggugaugaccgaugggucugccuccgaaagagcggacacaaaaauucuguuuaucgaggaaggaaagaucguccacauuagcccucuuuccggcucugcccaacauguugaggaaugcagcuguuauccccgguacccuggggugcgcugcguguguagagauaacuggaaaggauccaaccggcccaucgucgacauuaaugugaaggauuacagcaucguuucuuccuaugugugcagcggccuggucggcgacaccccgcgcaagaacgacucuagcuccucuagcuacuguagaaauccuaacaaugagaaagggucccacggagugaagggcugggcuuucgaugacgggaacgauguuuggaugggacggacaauuagcgaggaacuccgcucuggcuaugagaccuuuaaagugaucgggggaugguccaagcccaauagcaaacugcagaucaacagacaggucauuguggaccggggcaauagaucuggcuacuccgggaucuucagcgucgaaggaaaguccugcauuaaccgcuguuuuuauguggagcugauccggggcagaaaacaggaaacggagguuugguggacaucuaauagcauuguggucuucugcgggaccuccggaaccuacggcacagggucuuggccugauggcgccgacaucaaccucaugcccauuuga

SEQ ID NO: 204965 - RNA, 1410 nt, Artificial Sequence
  derived and/or modified sequence opt5 from neuraminidase__InfluenzaA__AFG72485
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaaaaucaccggguucgcgccuuuuuccaaggacaacucuauucgccuuagcgcuggaggcgauaucugggucacaagagagcccuacguguccugugacccugggaagugcuaucaauucgcccugggacagggcaccacacucaauaaccggcacucuaaugauaccguucaugaccgcacgccguacagaacacugcugaugaacgaacucggggugcccuuucaccugggaaccaaacaggucuguaucgccuggagcuccagcucuugccaugauggcaaggcuuggcuucacguguguguuacaggccacgacgagaaugccaccgcuuccuucauuuaugaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccauauuagcccucuuuccggcucugcccaacacguugaagagugcagcuguuacccccgguauccuggggugcgcugcguguguagagauaacuggaagggauccaaccggcccaucgucgacauuaaugugaaggauuacagcaucguuucuuccuacgugugcagcggccuggucggcgacaccccgcgcaaaaacgacucuagcuccucuagcuauuguagaaauccuaacaaugaaaaggggucccauggagugaaaggcugggcuuucgaugacgggaacgauguuuggaugggacggacaauuagcgaggagcuccgcucuggcuacgaaaccuuuaaggugaucgggggaugguccaaacccaauagcaagcugcagaucaacagacaggucauuguggaccggggcaauagaucuggcuauuccgggaucuucagcgucgagggaaaauccugcauuaaccgcuguuuuuacguggaacugauccggggcagaaagcaggagacggaaguuugguggacaucuaauagcauuguggucuucugcgggaccuccggaaccuauggcacagggucuuggccugauggcgccgacaucaaccucaugcccauuuga

SEQ ID NO: 204966 - RNA, 1410 nt, Artificial Sequence; identical to SEQ ID NO: 198125
  derived and/or modified sequence opt5 from neuraminidase__InfluenzaA__AFG72507

SEQ ID NO: 204967 - RNA, 1410 nt, Artificial Sequence
  derived and/or modified sequence opt5 from neuraminidase__InfluenzaA__AFG72529
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaagauucuccgcacccaggaaagcgagugcgucuguaucaacggcacaugcacgguggugaugaccgaugggucugccuccgagagagcggacacaaaaauucuguuuaucgaagagggaaagaucguccacauuagcccucuuuccggcucugcccaacauguugaagagugcagcuguuauccccgguacccuggggugcgcugcguguguagagauaauuggaagggauccaaccggcccaucgucgacauuaacgugaaagauuacagcaucguuucuuccuaugugugcagcggccuggucggcgacaccccgcgcaagaaugacucuagcuccucuagcuacugucagaacccuaauaacgaaaaugggucccacggagugaaaggcugggcuuucgaugacgggaacgauguuuggaugggaagaacaauuagcgaggagcuccggucuggcuaugaaaccuuuaaggugaucgggggaugguccaaacccaauagcaagcugcagaucaaccgccaggucauuguggacagaggcaaucggucuggcuacuccgggaucuucagcgucgagggaaaauccugcauuaacagauguuuuuauguggaacugauccgcggccggaagcaagagacggaaguuugguggacaucuaauagcauuguggucuucugcgggaccuccggaaccuacggcacagggucuuggccugauggcgccgacaucaaccucaugcccauuuga

SEQ ID NO: 204968 - RNA, 1410 nt, Artificial Sequence
  derived and/or modified sequence opt5 from neuraminidase__InfluenzaA__AFG72540
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucaagaaagagauuugucccaagcuggccgaauaccggaauuggucuaaaccucagugcaagaucaccggguucgcgcccuuuagcaaggacaacuccauucgccuuucugcuggaggcgauaucugggucacaagagagccuuaugugagcugugacccggggaaaugcuaccaauucgcccugggacagggcaccacacucaauaaccggcauuccaaugauaccguucacgaccgcacgcccuauagaacacugcugaugaacgagcucggggugccuuuucaucugggaaccaagcaggucuguaucgccuggucuagcuccagcugccacgauggcaaggcuuggcuucauguguguguuacaggccacgacgaaaaugccaccgcuucuuucauuuacgaugggcggcugguggacuccaucggaagcuggucuaaaaacauucuccgcacccaggaguccgaaugcgucuguaucaauggcacaugcacgguggugaugaccgaugggagcgccucugagagagcggacacaaaaauucuguuuaucgaggaaggaaagaucguccacauuagcccccuuuccggcuccgcccaacauguugaggaaugcucuuguuauccucgguaccccggggugcgcugcguguguagagauaacuggaagggaagcaaccggccgaucgucgacauuaaugugaaagauuacuccaucguuagcucuuaugugugcuccggccuggucggcgacaccccucgcaagaacgacagcucuagcuccucuuacuguuggaaucccaacaaugagaaagggggacacggcgugaaggggugggcuuucgaugacggaaacgauguuuggaugggcagaacaauuagcgaggaacuccgguccggguaugagaccuuuaaagugaucggaggcuggagcaagccuaauucuaaacugcagaucaaccgccaggucauuguggacagaggcaaucgguccggguacagcggaaucuucucugucgaaggcaaguccugcauuaacagauguuuuuauguggagcugauccgcgggcggaagcaggaaacggagguuugguggacaagcaauuccauuguggucuucugcggaaccucuggcaccuacgggacaggcagcuggcccgauggagccgacaucaaccucaugcccauuuga

SEQ ID NO: 204969 - RNA, 1410 nt, Artificial Sequence
  derived and/or modified sequence opt5 from neuraminidase__InfluenzaA__AFG72562
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguuggaauccuaacaaugaaaaagggggacacggcgugaaggggugggcuuucgaugacggaaacgauguuuggaugggcagaacaauuuccgaggagcuccggagcggguaugaaaccuuuaaggugaucggaggcuggucuaaacccaauuccaagcugcagaucaaccgccaggucauuguggacagaggcaaucggagcggguacucuggaaucuucuccgucgagggcaaaagcugcauuaacagauguuuuuauguggaacugauccgcgggcggaagcaggagacggaaguuugguggacauccaauucuauuguggucuucugcggaaccagcggcaccuacgggacaggcuccuggccugauggagccgacaucaaccucaugcccauuuga

SEQ ID NO: 204970 - RNA, 1410 nt, Artificial Sequence
  derived and/or modified sequence opt5 from neuraminidase__InfluenzaA__AFG72584
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaagucuguccuaaacuggccgaguaccggaauuggagcaagccccagugcaaaauuaccggguucgcgccuuuuuccaaggacaacucuauccgccuuagcgcuggaggcgauauuugggugacaagagagcccuauguuuccugugacccugggaagugcuaccaauucgcccugggacagggcaccacacucaauaacaaacauucuaaugauaccgugcacgaccggacgccguaucgcacacugcugaugaacgaacucgggguccccuuucaucugggaaccaaacagguguguaucgccuggagcuccagcucuugccacgauggcaaggcuuggcuucauguuugugugacaggccacgacgagaaugccaccgcuuccuucaucuacgaugggagacuggucgacagcauuggaucuugguccaagaacauccuccggacccaggaaagcgagugcguguguauuaauggcacaugcacgguggucaugaccgaugggucugccuccgagaaagcggacacaaagauccuguuuauugaagagggaaagaucguucacaucagcccucuuuccggcucugcccaacauguggaagagugcagcuguuauccccgcuacccuggggugagaugcgucugucgggauaacuggaaaggauccaaccgccccauuguggacaucaauguuaaggauuacagcauugugucuuccuaugucugcagcggccuggugggcgacaccccgagaaagaacgacucuagcuccucuagcuacuguuggaauccuaacaaugaaaaagggggacacggcguuaaagggugggcuuucgaugacggaaacgauguguggaugggccggacaaucuccgaggagcuccgcagcggguaugaaaccuuuaaggucauuggaggcuggucuaaacccaauuccaagcugcagaucaacagacaggugaucgucgaccggggcaaucgcagcggguacucuggaauuuucuccguggagggcaagagcugcaucaacagauguuuuuauguugaacugauucgggggagaaaacaggagacggaagugugguggacauccaauucuaucgucguguucugcggaaccagcggcaccuacgggacaggcuccuggccugauggagccgacauuaaccucaugcccaucuga

SEQ ID NO: 204971 - RNA, 1410 nt, Artificial Sequence
  derived and/or modified sequence opt5 from neuraminidase__InfluenzaA__AFG72606
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggaucacagcaucguuucuuccuacgugugcagcggccuggucggcgacaccccgcgcaaaaacgacucuagcuccucuagcuauugucucaauccuaacaaugaagaagggggacauggcgugaaggggugggcuuucgaugacggaaacgauguuuggaugggcagaacaauuuccgagaaacugcggagcggguacgagaccuuuaaggugaucggaggcuggucuaaacccaauuccaagcugcagaucaaccgccaggucauuguggacagaggcaaucggagcggguauucuggaaucuucuccgucgagggcaaaagcugcgugaacagauguuuuuacguugaacucauucgcgggcggaagcaggagacggaagugugguggacauccaauucuaucgucguguucugcggaaccagcggcaccuaugggacaggcuccuggccugauggagccgacauuaaccugaugcccaucuga

SEQ ID NO: 204972 - RNA, 1410 nt, Artificial Sequence
  derived and/or modified sequence opt5 from neuraminidase__InfluenzaA__AFG72617
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccggcagagccgauacaaagauccuguuuaucgaggaaggaaaaauuguccacaucagcccucuuuccgggucugcgcaacauguugaggaauguagcugcuacccccgguauccuggagugcgcugugugugcagagacaacuggaagggcuccaaucggcccauugucgauaucaacgugaaggacuacagcauuguuucuuccuacguguguagcggccuggucggggauaccccgcgcaaaaaugacucuagcuccucuagcuauugccucaacccuaauaacgaggaaggaggccacggggugaagggaugggccuucgacgauggcaaugacguuuggauggggagaacaaucuccgagaaacugcggagcggauacgagaccuuuaaggugaucggcggcuggucuaaacccaacuccaagcugcagauuaaucgccaggucaucguggauagagggaaccggagcggauauucuggcauuuucuccgucgaagggaaaagcuguaucaauagaugcuuuuacguggagcucauucgcggacggaagcaggaaacggagguuugguggacauccaacucuaucguggucuucuguggcaccagcgggaccuauggcacaggauccuggccugacggcgcugauauuaaucugaugcccaucuga

SEQ ID NO: 204973 - RNA, 1410 nt, Artificial Sequence
  derived and/or modified sequence opt5 from neuraminidase__InfluenzaA__AFG72628
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuuuccggcucugcccaacauguugaggaaugcagcuguuauccccgguacuccggggugcgcugcguguguagagacaauuggaagggaagcaaccggccuaucgucgauauuaacgugaaagacuacucuaucguuuccagcuaugugugcucuggccuggucggcgacacaccccgcaagaaugauagcuccucuagcucccacugucucaacccgaauaacgaggaagggggacauggcgugaaagggugggcuuucgacgauggaaaugacguuuggaugggcagaaccauuagcgagaagcugcggucuggguacgagaccuuuaaagugaucggaggcugguccaagccuaacagcaaacugcagaucaaucgccaggucauuguggauagaggcaaccggucuggguauuccggaaucuucagcgucgaaggcaaguccugcauuaauagauguuuuuacguggagcucauccgcgggcggaagcaggaaacggagguuugguggacaucuaacagcauuguggucuucugcggaaccuccggcaccuaugggacaggcucuuggcccgacggagccgauaucaaucugaugccuauuuga

SEQ ID NO: 204974 - RNA, 1410 nt, Artificial Sequence; identical to SEQ ID NO: 198004
  derived and/or modified sequence opt5 from neuraminidase__InfluenzaA__AFG72639

SEQ ID NO: 204975 - RNA, 1410 nt, Artificial Sequence
  derived and/or modified sequence opt5 from neuraminidase__InfluenzaA__AFG72650
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacugucucaauccuaacaaugaagaagggggacacggcgugaaggggugggcuuucgaugacggaaacgauguuuggaugggcagaacaauuuccgagaaacugcggagcggguaugagaccuuuaaggugaucggaggcuggucuaaacccaauuccaagcugcagaucaaccgccaggucauuguggacagaggcaaucggagcggguacucuggaaucuucuccgucgagggcaaaagcugcgugaacagauguuuuuauguugaacucauucgcgggcggaagcaggagacggaagugugguggacauccaauucuaucgucguguucugcggaaccagcggcaccuacgggacaggcuccuggccugauggagccgacauuaaccugaugcccaucuga

SEQ ID NO: 204976 - RNA, 1410 nt, Artificial Sequence; identical to SEQ ID NO: 204973
  derived and/or modified sequence opt5 from neuraminidase__InfluenzaA__AFG72672

SEQ ID NO: 204977 - RNA, 1407 nt, Artificial Sequence
  derived and/or modified sequence opt5 from neuraminidase__InfluenzaA__AFG72683
augaaccccaaucagaagaucauuaccaucggcagcgugucccugacaauugccacgaucugcuuccucaugcaaauugcuauccuggucaucaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugggaagugcuaccaauucgcccugggacagggcacaacccucaauaaccggcauucuaaugaaguucacgaucgcacaccguauagaacccugcugaugaacgagcucggggugcccuuucaucugggaacgaaacaggucuguauugccuggagcuccagcucuugccacgacggcaaggcuuggcuucauguguguguuacaggccacaaugaaaacgccaccgcuuccuucaucuacgaugggcggcugguggacagcauuggaucuugguccaaaaauauccuccgcacacaggagagcgagugcgucuguauuaacggaaccugcaccguggugaugacagaugggucugccuccggcagagcggacacgaagauccuguuuaucgaagagggcaaaauuguccacaucagcccucuuuccgggucugcccaacauguugaagagugcagcuguuauccccgguacccuggagugcgcugcguguguagagauaacuggaagggcuccaaucggcccauugucgacaucaacgugaaggauuacagcauuguuucuuccuaugugugcagcggccuggucggggacaccccgcgcaaaaaugauucuagcuccucuagccacugucucaacccuaauaacgaagagggaggccauggggugaagggaugggcuuucgacgacggcaaugauguuuggauggggagaacaaucuccgagaaacugcggagcggauacgaaaccuuuaaggugaucggcggcuggucuaaacccaacuccaagcugcagauuaaucgccaggucaucguggacagagggaaccggagcggauauucuggcauuuucuccgucgaggggaaaagcugcaucaauagauguuuuuacguggaacucauucgcggacggaagcaggagacagaaguuugguggaccuccaacucuaucguggucuucugcggcacgagcgggacauauggcaccggauccuggccugauggcgccgacauuaaucugaugcccaucuga

SEQ ID NO: 204978 - RNA, 1410 nt, Artificial Sequence
  derived and/or modified sequence opt5 from neuraminidase__InfluenzaA__AFG72705
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagccaacuuuccggcucugcccagcauguugaggaaugcagcuguuauccucgguaccccggggugcgcugcguguguagagacaauuggaagggauccaaccggccuaucgucgauauuaacgugaaagaccacagcaucguuucuuccuacgugugcagcggccuggucggcgacacaccccgcaagaaugauucuagcuccucuagccauugucucaacccgaauaacgaggaagggggacacggcgugaaagggugggcuuucgacgauggaaaugacguuuggaugggcagaaccauuuccgagaagcugcggagcggguaugagaccuuuaaagugaucgaaggauggucuaagccuaacuccaaacugcagaucaaucgccaggucauuguggauagaggcaaccggagcggcuacucugggaucuucuccgucgagggaaagagcugcauuaauagauguuuuuauguggaacucauccgcggccggaagcaagagacggaaguuugguggacauccaacucuauuguggucuucugcgggaccagcggaaccuacggcacaggguccuggcccgacggcgccgauaucaaucugaugccuauuuga

SEQ ID NO: 204979 - RNA, 1410 nt, Artificial Sequence
  derived and/or modified sequence opt5 from neuraminidase__InfluenzaA__AFG72716
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccggcagagccgauacaaagauccuguuuaucgaggaaggaaaaauuguccacaucagcccucuuuccgggucugcgcaacauguugaggaauguagcugcuacccccgguauccuggagugcgcugugugugcagagacaacuggaagggcuccaaucggcccauugucgauaucaacgugaaggacuacagcauuguuucuuccuacguguguagcggccuggucggggauaccccgcgcaaaaaugacucuagcuccucuagcuauugccucgacccuaacaaugaggaaggaggccacggggugaagggaugggccuucgaugacggcaacgauguuuggauggggagaacaaucuccgagaaaagccggucuggauacgagaccuuuaaggugaucggcggcugguccaaacccaauagcaagcugcagauuaaccgccaggucaucguggacagagggaaucggucuggauauuccggcauuuucagcgucgaagggaaauccuguaucaacagaugcuuuuacguggagcugauucgcggacggagacaggaaacggagguuugguggacaucuaauagcaucguggucuucuguggcaccuccgggaccuauggcacaggaucuuggccugauggcgcugacauuaaccucaugcccaucuga

SEQ ID NO: 204980 - RNA, 1410 nt, Artificial Sequence
  derived and/or modified sequence opt5 from neuraminidase__InfluenzaA__AFG72738
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccggcagagccgauacaaagauccuguuuaucgaggaaggaaaaauuguccacaucagccaacuuuccgggucugcgcagcauguugaggaauguagcugcuacccucgguaucccggagugcgcugugugugcagagacaacuggaagggcuccaaucggccuauugucgauaucaacgugaaggacuacagcauuguuucuuccuacguguguagcggccuggucggggauacaccccgcaaaaaugacucuagcuccucuagcuauugccucgacccgaacaaugaggaaggaggccacggggugaagggaugggccuucgaugacggcaacgauguuuggauggggagaaccaucuccgagaaacugcggagcggauacgagaccuuuaaggugaucggcggcuggucuaaaccuaauuccaagcugcagauuaaccgccaggucaucguggacagagggaaucggagcggauauucuggcauuuucuccgucgaagggaaaagcuguaucaacagaugcuuuuacguggagcucauucgcggacggaagcaagaaacggagguuugguggacauccaauucuaucguggucuucuguggcaccagcgggaccuauggcacaggauccuggcccgauggcgcugacauuaaccugaugccuaucuga

SEQ ID NO: 204981 - RNA, 1410 nt, Artificial Sequence; identical to SEQ ID NO: 198209
  derived and/or modified sequence opt5 from neuraminidase__InfluenzaA__AFG72749

SEQ ID NO: 204982 - RNA, 1410 nt, Artificial Sequence; identical to SEQ ID NO: 197597
  derived and/or modified sequence opt5 from neuraminidase__InfluenzaA__AFG72760

SEQ ID NO: 204983 - RNA, 1410 nt, Artificial Sequence; identical to SEQ ID NO: 197064
  derived and/or modified sequence opt5 from neuraminidase__InfluenzaA__AFG72771

SEQ ID NO: 204984 - RNA, 1410 nt, Artificial Sequence
  derived and/or modified sequence opt5 from neuraminidase__InfluenzaA__AFG72782
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuuuaucgaggaaggaaagaucauucacaccagccaacuguccggcucugcccagcaugucgaggaaugcagcuguuauccccgguacccugggguucgcugcguguguagagacaauuggaagggauccaaccggcccaucguggauauuaacgucaaagacuacagcaucgugucuuccuauguuugcagcggccucgugggcgacacaccucgcaagaaugauucuagcuccucuagccacugucugaaccccaauaacgaggaagggggacauggcgucaaagggugggcuuucgacgauggaaaugacguguggaugggcagaaccauuuccgagaaguuucggagcggguacgagacguucaaaguuaucgaaggauggucuaagccgaacuccaaacugcagaucaaucgccaggugauugucgauagagacaaccggagcggcuauucuggcaucuuuuccguggagggaaagagcugcauuaauagauguuucuacgucgaacucauccgcgggcggaagcaagagacagaagugugguggaccuccaacucuauuguuguguuuugcggcaccagcgggacauauggaaccggcuccuggccugauggggccgacaucaaucugaugcccauuuga

SEQ ID NO: 204985 - RNA, 1410 nt, Artificial Sequence; identical to SEQ ID NO: 198773
  derived and/or modified sequence opt5 from neuraminidase__InfluenzaA__AFG72793

SEQ ID NO: 204986 - RNA, 1410 nt, Artificial Sequence; identical to SEQ ID NO: 197308
  derived and/or modified sequence opt5 from neuraminidase__InfluenzaA__AFG72804

SEQ ID NO: 204987 - RNA, 1410 nt, Artificial Sequence; identical to SEQ ID NO: 198953
  derived and/or modified sequence opt5 from neuraminidase__InfluenzaA__AFG72826

SEQ ID NO: 204988 - RNA, 1410 nt, Artificial Sequence
  derived and/or modified sequence opt5 from neuraminidase__InfluenzaA__AFG72837
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaacggacgccguaucgcacacugcugaugaaugagcucggggugcccuuucaucugggaaccaagcaggucuguaucgccuggagcuccagcucuugccacgauggcaaagccuggcuucauguguguguuacaggcgacgaugaaaacgcuaccgcuuccuucauuuacaaugggagacugguggacagcaucggaucuugguccaagaaaauucuccggacccaggagagcgagugcgucuguaucaacggcacaugcacgguggugaugaccgaugggucugccuccggaaaggcggacacaaaaauucuguuuaucgaagagggcaagaucguccacauuagcacccuuuccgggucugcccaacacguugaagagugcagcuguuauccucgcuaccccggagugagaugcgugugucgggauaacuggaagggcuccaaucgcccuaucgucgacauuaacgugaaagauuacagcaucguuucuuccuaugugugcagcggccuggucggggacacacccagaaagaaugacucuuucagcuccucucauugucucgauccgaacaaugaagagggaggccacggggugaaaggaugggcuuuugacgauggcaacgacguuuggauggggcggaccauuagcgagaagcugcgcuccggauacgaaacguucaaagugaucgagggcuggagcaagccuaauucuaaacugcagaucaacagacaggucauuguggaacggggcaaucgcuccggguauagcggaaucuuuucugucgagggcaaguccugcauuaacagauguuucuacguggaacucauccgggggagaaaggaggagacagaaguuugguggaccagcaauuccauuguggucuuuugcggaaccucuggcacauaugggaccggcagcuggcccgauggagccgacaucaaccugaugccuauuuga

SEQ ID NO: 204989 - RNA, 1413 nt, Artificial Sequence
  derived and/or modified sequence opt5 from neuraminidase__InfluenzaA__AFG72848
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaaagcgccgaguaccggaauugguccaagccccagugcaacaucaccggguucgcgccuuuuucuaaagacaauagcauucgccuguccgcuggaggcgauaucugggucacaagagagcccuaugugucuugugacccugauaagugcuaccaauucgcccuugggcagggaaccacacugaacaauggccauagcaacgacaccguucacgaucggacgccguaucgcacacuccugaugaaugaacugggggugcccuuucaucucggaaccagacaggucuguaucgccugguccucuagcuccugccacgacggcaaggcuuggcugcauguguguguuacaggcgaugacaaaaacgccaccgcuagcuucauuuacaaugggcggcuuguggauucuaucggauccuggagcaagaaauauauucugcgcacccaggagucugaaugcgucuguaucaacggcacaugcacgguggugaugaccgacggguccgccagcggaaaggcggauacaaaaauucucuuuaucgaggagggcaagaucauucacaucuccacccugucugggagcgcccaacacgucgaagagugcuccuguuacccuagauaccccggaguucggugcgugugucgcgacaacuggaagggcagcaauagaccuauuguggauaucaacgucaaagacuauucuauuguguccagcuacguuugcucuggccuugugggggacacaccccggaagaaugauagcuccucuagcucccauugucuggacccgaacaaugaagagggaggccacggggucaaaggaugggcuuucgaugacggcaacgauguguggauggggcgcaccaucagcgaaaagcucagaucuggauaugagacguuuaaaguuaucgagggcugguccaagccuaauagcaaacugcagauuaaccgccaggugaucgucgaacggggcaauagaucuggguacuccggaauuuucagcguggagggcaaguccugcaucaaccgguguuuuuaugucgaacugauuagagggcgcaaggaggaaacagaggugugguggaccucuaauagcaucguuguguucugcggaaccuccggcacauacgggaccggcucuuggcccgacggagccgauauuaaccucaugccuaucuga

SEQ ID NO: 204990 - RNA, 1410 nt, Artificial Sequence
  derived and/or modified sequence opt5 from neuraminidase__InfluenzaA__AFG72859
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacauuguucacgaucggaccccguaucgcacgcuccugaugaaugaacugggcgugcccuuucaucucgggacaaagcaggucugcaucgccugguccucuagcuccugucacgacggaaaagccuggcugcaugugugcguuaccggcgaugacgagaacgcuacagccagcuucauuuacaauggcagacuuguggauucuaucgucuccuggagcaagaaaauucugcggacccaggaaucugagugugugugcaucaacgggaccuguacaguggucaugacggacggauccgcuagcggcaaggccgauaccaaaauccucuuuauugaggaagggaagaucguucacacauccacccugucuggaagcgcgcaacacguggaggaaugcuccugcuauccucgcuaccccggcgugagaugugucugccgggacaacuggaaggggagcaaucgcccuauuguggauaucaacauuaaagacuacucuaucguuuccagcuauguguguucuggacuugucggcgacacacccagaaagaaugauagcuccucuagcucccauugccuggacccgaacaaugaggaaggcgggcacggagugaaaggcugggccuucgaugacgggaacgauguuuggaugggacggaccaucagcgagaagcuccgcucuggcuacgagacguuuaaagugauugaagggugguccaauccuaacagcaagcugcagaucaauagacaggucauuguggaccggggaaaccgcucuggcuauuccggcaucuucagcgucgaggggaaauccuguauuaauagaugcuuuuacguggaacugauccggggaagaaagcaggagacagaaguucucuggaccucuaacagcauuguggucuucuguggcaccuccgggacauauggaaccggcucuuggcccgauggggcugacaucaaucugaugccuaucuga

SEQ ID NO: 204991 - RNA, 1410 nt, Artificial Sequence
  derived and/or modified sequence opt5 from neuraminidase__InfluenzaA__AFG72870
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucuacauccggaaaggccgauaccaaaauucuguuuaucgaggaaggcaagaucguccacauuagcacacuuuccgggucugcgcaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccuggucggggacacccccagaaagaaugauucuuucagcuccucucauugucucgacccgaacaaugaggaaggaggccacggggugaaaggaugggccuuugaugacggcaacgauguuuggauggggcggacgauuagcgagaagcugcgcuccggauacgagacauucaaagugaucgaaggcuggagcaagccuaauucuaaacugcagaucaacagacaggucauuguggagcggggcaaucgcuccggguauagcggaaucuuuucugucgaauccaagagcugcauuaacagauguuucuacguggagcucauccggggcagaaaggaagagaccgagguuugguggaccuccaauucuauuguggucuuuugcgggacaagcggaaccuauggcacaggguccuggcccgacggcgcugauaucaaccugaugccuauuuga

SEQ ID NO: 204992 - RNA, 1410 nt, Artificial Sequence
  derived and/or modified sequence opt5 from neuraminidase__InfluenzaA__AFG72892
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggagaagaccgaaguucucuggaccucuaauagcaucguggucuucuguggcacauccgggaccuauggaacaggcucuuggcccgacggggcugauauuaaccugaugccuaucuga

SEQ ID NO: 204993 - RNA, 1410 nt, Artificial Sequence
  derived and/or modified sequence opt5 from neuraminidase__InfluenzaA__AFG72903
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaagauagcuccucuagcucccauugccuggacccgaauaacgaggaaggcgggcacggagugaagggcugggccuucgaugacgggaaugauguuuggaugggacggacgaucagcgagaaacuccgcucuggcuacgagacauuuaaggugaucgaagggugguccaacccuaauagcaaacugcagauuaacagacaggucaucguggaccggggagaucgcucuggcuauuccggcauuuucagcgucgaggggaaguccuguaucaauagaugcuuuuacguggaacugauucggggaagaaaggaggaaaccgagguucucuggaccucuaacagcaucguggucuucuguggcacauccgggaccuauggaacaggcucuuggcccgacggggcugauauuaaucugaugccuaucuga

SEQ ID NO: 204994 - RNA, 1410 nt, Artificial Sequence
  derived and/or modified sequence opt5 from neuraminidase__InfluenzaA__AFG72936
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauccgccuguccgcgggaggcgacauuugggugacaagagagcccuaugucucuugcgauccugacaaguguuaccaauucgcucuugggcagggaaccacacugaauaacgugcauagcaauaacaucguucgggaucgcaccccguauagaacgcuccugaugaaugaacugggcgugcccuuucaccucgggacaaagcaggucugcauugccugguccucuagcuccugucaugacggaaaagccuggcugcacgugugcaucaccggcgaugacaagaacgcuacagccagcuucauuuacaauggccggcuuguugauucuguggucuccuggagcaaagagauccugcgcacccaggaaucugagugugugugcaucaacgggaccuguacaguggucaugacggacggauccgcuagcggcaaggccgauaccaaaauucucuuuaucgaggaagggaagauuguucauacauccacccugucuggaagcgcgcaacacguggaggaaugcuccugcuauccuagauaccccggcgugcggugugucugccgcgacaacuggaaggggagcaauagaccuaucguggauauuaacaucaaagaccacucuaucguuuccagcuacguguguucuggacuugucggcgacacaccccggaagaaugauagcuccucuagcucccauugccuggacccgaacaaugaggaaggcgggcacggagugaaaggcugggccuucgaugacgggaacgauguuuggaugggacgcaccauuagcgagaagucuagacucggcuaugagacguuuaaagugaucgaagggugguccaaucauaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaacagagguucucuggaccucuaauagcaucguggucuucuguggcaccuccgggacauacggaaccggcucuuggccugauggggcugaccugaaccuuaugcccaucuga

SEQ ID NO: 204995 - RNA, 1410 nt, Artificial Sequence
  derived and/or modified sequence opt5 from neuraminidase__InfluenzaA__AFG72958
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacauuguucgggaucgcaccccguauagaacgcuccugaugaaugaacugggcgugcccuuucaccucgggacaaagcaggucugcaucgccugguccucuagcuccugucaugacggaaaagccuggcugcacgugugcauuaccggcgaugacaagaacgcuacagccagcuucaucuacaauggccggcuuguugauucuguggucuccuggagcaaagagauucugcgcacccaggaaucugagugugugugcaucaacgggaccuguacaguggucaugacggacggauccgcuagcggcaaggccgauaccaaaauccucuuuauugaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacaccccggaagaaugauagcuccucuagcucccauugccuggacccgaacaaugaggaaggcgggcacggagugaaaggcugggccuucgaugacgggaacgauguuuggaugggacgcaccaucaaugagacgagcagacucggcuaugagacauuuaaggugauugaaggguggucuaacccuaaauccaagcugcagaucaaucggcaggucauuguggaccgcggaaacagaagcggcuacucuggcaucuucuccgucgaggggaaaagcuguauuaaucggugcuuuuauguggaacugaucagaggacgcaaggaggaaaccgagguucucuggaccuccaacucuauuguggucuucuguggcacaagcgggaccuacggaacaggcuccuggcccgauggggcugaccugaaucuuaugccuaucuga

SEQ ID NO: 204996 - RNA, 1410 nt, Artificial Sequence; identical to SEQ ID NO: 197127
  derived and/or modified sequence opt5 from neuraminidase__InfluenzaA__AFG98811

SEQ ID NO: 204997 - RNA, 1410 nt, Artificial Sequence
  derived and/or modified sequence opt5 from neuraminidase__InfluenzaA__AFG98822
augaaccccaaucagaagaucauuaccaucggcagcgugucccugauuaucgccacagucugcuuccucaugcaaauugcuauccugguuacgaccgugacacuucacuuuaaacagcaugagugugacucuccuagcuccaaccaggugaugcugugcgaaccgaucauuaucgagagaaauauuaccgaaaucgucuaccucaacaauacaaccauugagaaggaaacaugucccaaacugguggaguaucggaacuggucuaagccucagugcaaaaucaccggguucgcccccuuuagcaaggauaauuccauucgccuuucugcgggaggcgacaucuggguuacgagagagccuuacgugagcugugaucccgggaagugcuaucaauucgcucugggacagggcaccacacucgacaacaaacacuccaaugauaccauccaugaccggauuccucaccgcacacugcugaugaacgaacucggggucccguuucaucugggaaccagacagguguguaucgccuggucuagcuccagcugccacgauggcaaggccuggcuucacguuugugugacgggcgacgauaaaaaugcuacagccucuuucauuuacgacgggcggcuggucgauuccaucggaagcuggucucagaacauucuccgcacccaagaguccgaaugcguguguaucaauggcacaugcaccguggucaugaccgacgggagcgcuuccggcagagccgauacacggauccuguuuauugaggagggaaagaucguucauauuucuccccuuagcggguccgcgcagcacguggaagagugcagcuguuauccucgcuaccccgacgugagaugcaucugucgggacaacuggaaaggaucuaaucgcccuauugucgauaucaacaugaaggacuauuccaucgauagcucuuacgugugcagcggccugguuggcgacacgcccagaaacgaugaccgguccucuaagagcaauugucgcaacccgaauaacgaaagagggaaucauggagugaaaggcugggccuucgauaacgggaaugacgucuggaugggacggaccauuuccaaggaucucagaagcggcuacgagacauuuaaagugaucgggggauggucuaccccuaacuccaagagccagauuaaucgccagguuaucguggacucugauaaccgguccggcuauagcggcauuuucuccgucgaagggaaaucuugcaucaauagauguuuuuacguggagcugauucgcggacgggagcaagaaacaagagucugguggaccagcaacuccaucgugguuuucugcggcacgucugggacauauggaaccggcagcuggcccgacggggcuaauaucaacuuuaugccuauuuga

SEQ ID NO: 204998 - RNA, 1410 nt, Artificial Sequence; identical to SEQ ID NO: 203151
  derived and/or modified sequence opt5 from neuraminidase__InfluenzaA__AFG98833

SEQ ID NO: 204999 - RNA, 1410 nt, Artificial Sequence
  derived and/or modified sequence opt5 from neuraminidase__InfluenzaA__AFG98844
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaauguguccuaaacucgucgaguaccggaacuggagcaagccccagugcaaaaucacgggguucgcgccuuuuuccaaggauaauucuauucgccugagcgcuggaggcgacaucugggugaccagagagcccuauguuuccugugauccugggaagugcuaccaauucgcccuuggacagggcacaacccugaacaaucggcauucuaacgacacaauccacgaucgcauuccgcauagaacccuccugaugaaugaacugggggugcccuuucaccucggaacgcggcaggucuguaucgccuggagcuccagcucuugccaugacggcaaggcuuggcugcacguguguguuacaggcgaugacaaaaacgccaccgcuuccuucauuuaugaugggcgccuuguggacagcaucggaucuuggucccagaauauucugagaacacaagagagcgaaugcgucuguaucaaccggaccugcaccguggugaugacagauggcucugccuccgggaaagcggacacgcgcauccucuuuauugaggagggaaagaucguccacauuagcccucuguccggcucugcccagcauguugaagagugcagcuguuaccccagauauccuggggugcggugcaucugucgcgauaauuggaaaggauccaacagacccguggucgacauuaacgugaaggacuacagcaucgauucuuccuacguuugcagcggccuugugggcgacaccccgcggaauaacgaucgcucuagcuccucuuauuguagaaauccuaacaaugaacgggggaaccacggagucaagggcugggcuuucgacgaugagaaugacguguggauggggagaacaaucagcaaagauucccgcagcggauacgaaaccuuuaagguuauuggcggguggucuacacccaacuccaaaagccagaucaauagacaggugauugucgacucugauaaccgguccggauauagcggcaucuucuccguggagggcaagucuugcauuaaucgcuguuuuuacgucgagcugauccgggggagagaacaagagacccgcgugugguggacgagcaacuccauuguuguguucugcggaacaucuggcaccuaugggaccggaagcuggccugacggcgccgauaucaaucucaugcccaucuga

SEQ ID NO: 205000 - RNA, 1410 nt, Artificial Sequence; identical to SEQ ID NO: 197142
  derived and/or modified sequence opt5 from neuraminidase__InfluenzaA__AFG98855

SEQ ID NO: 205001 - RNA, 1410 nt, Artificial Sequence; identical to SEQ ID NO: 197996
  derived and/or modified sequence opt5 from neuraminidase__InfluenzaA__AFG98866

SEQ ID NO: 205002 - RNA, 1410 nt, Artificial Sequence
  derived and/or modified sequence opt5 from neuraminidase__InfluenzaA__AFG98877
augaaccccaaucagaagaucauuaccaucggcagcgugucccugacaauugccacgaucugcuuccucaugcaaauugcuauccuggucaccacaguuacccuucacuuuaaacaguacgagugugacucuccuccgaacaaucaggugaugcccugcgaaccuaucauuaucgagagaaacauuacagaaaucguguaucugaccaauacaaccauugagaaggaaaucugucccaaacucgucgaguaccggaacuggagcaagccucagugcaaaauuacgggguucgcccccuuuuccaaggauaauucuauccgccugagcgcgggaggcgacaucugggugaccagagagccuuauguuuccugugauccggggaagugcuaccaauucgcucuuggacagggcacaacccuggacaacaaacauucuaaugauacaauucacgaccggacgccccaucgcacccuccugaugaacgaacugggggugccuuuucaccucggaacaagacaggucuguaucgccuggagcuccagcucuugccaugauggcaaggccuggcugcacguguguguuaccggcuaugacaaaaaugcuacagccuccuucauuuacgaugggcggcuuguggacagcaucggaucuuggucccagaacauucugcgcacccaagagagcgaaugcgucuguaucaauggaaccugcacaguggugaugacggaugggucugcuuccggcagagccgacaccaagauccucuuuauugaggagggcaaaaucguccacauuagcccccuguccgggucugcgcagcauguugaagagugcagcuguuauccucgguaccccggagugcgcugcaucuguagagauaacuggaagggcuccaaucggccgguggucgacauuaacgugaaggacuacagcaucgauucuuccuauguuugcagcggccuugugggggacacaccucgcaacaaugauagaucuagcaacuccuacugucggaaucccaacaaugaaaaaggaaaccacggcgucaaggggugggccuucgacgauggaaaugacguguggaugggccgcaccaucucugaggauagcagauccggguaugaaacauuuaaaguuauuggaggcuggagcaccccuaacucuaagcugcagaucaauagacaggugauugucgacuccgauaaccggagcggcuacucugggaucuucuccguggagggaaaaagcugcauuaaucgcuguuuuuaugucgagcucauccggggcagagaacaagagacgcgcgugugguggacauccaacucuauuguuguguucugcgggaccagcggaaccuacggcacaggguccuggcccgacggcgcugauaucaaucugaugcccaucuga

SEQ ID NO: 205003 - RNA, 1410 nt, Artificial Sequence; identical to SEQ ID NO: 197142
  derived and/or modified sequence opt5 from neuraminidase__InfluenzaA__AFG98888

SEQ ID NO: 205004 - RNA, 1410 nt, Artificial Sequence
  derived and/or modified sequence opt5 from neuraminidase__InfluenzaA__AFG98899
augaaccccaaucagaagaucauuaccaucggcagcgugucccugauuaucgccacaauuugcuuccucaugcaaaucgcuauccuggucacgaccguuacacuucacuuuaaacaguacgagugugacucuccugccaacaaucaggugaugccgugcgaacccauuaucauugagagaaacaucaccgaaauuguguaucugacaaauaccacaaucgagaaggaaauuuguccuaaacucgucgaguaccggaacuggagcaagccccagugcaaaaucaccggguucgcgccuuuuuccaaggauaauucuauccgccugagcgcuggaggcgacauuugggugacgagagagcccuauguuuccugugauccugggaagugcuaccaauucgcccuuggacagggcaccacacuggacaacaaacauucuaaugauaccauccacgaccggacaccgcaucgcacccuccugaugaacgaacugggggugcccuuucaccucggaacgagacaggucuguauugccuggagcuccagcucuugccaugauggcaaggcuuggcugcacguguguguuacaggcuaugacaaaaaugccaccgcuuccuucaucuacgaugggcggcuuguggacagcauuggaucuuggucccagaacauccugcgcacacaagagagcgaaugcgucuguaucaauggaaccugcaccguggugaugacagaugggucugccuccggcagagcggacacgaagauucucuuuaucgaggagggcaaaauuguccacaucagcccucuguccgggucugcccagcauguugaagagugcagcuguuauccccgguacccuggagugcgcugcauuuguagagauaacuggaagggcuccaaucggcccguggucgacaucaacgugaaggacuacagcaucgauucuuccuauguuugcagcggccuugugggggacaccccgcgcaacaaugauagaucuagcaacuccuacugucggaauccuaacaaugaaaaaggaaaccacggcgucaaggggugggcuuucgacgauggaaaugacguguggaugggccgcacaauuucugaggauagcagauccggguaugaaaccuuuaaaguuaucggaggcuggagcacacccaacucuaagcugcagauuaauagacaggugaucgucgacuccgauaaccggagcggcuacucugggauuuucuccguggagggaaaaagcugcaucaaucgcuguuuuuaugucgagcucauucggggcagagaacaagagacccgcgugugguggacguccaacucuaucguuguguucugcgggacaagcggaaccuacggcaccggguccuggccugacggcgccgauaucaaucugaugcccauuuga

SEQ ID NO: 205005 - RNA, 1410 nt, Artificial Sequence; identical to SEQ ID NO: 197142
  derived and/or modified sequence opt5 from neuraminidase__InfluenzaA__AFG98910

SEQ ID NO: 205006 - RNA, 1410 nt, Artificial Sequence; identical to SEQ ID NO: 197142
  derived and/or modified sequence opt5 from neuraminidase__InfluenzaA__AFG98921

SEQ ID NO: 205007 - RNA, 1410 nt, Artificial Sequence
  derived and/or modified sequence opt5 from neuraminidase__InfluenzaA__AFG98932
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuguggagagaaacaucacagaaauugucuaucugaccaauacaaccaucgagaaggaaauuuguccuaaacucguggaguaccggaaguggagcaaaccccagugcaagaucacgggguucgcgccuuuuuccaaggauaacucuauucgccugagcgcuggaggcgacaucuggguuaccagagagcccuauguguccugugauccugggaaaugcuaccaauucgcccuuggacagggcacaacccuggacaauaagcauucuaacgauacaauccacgaccggaccccgcaucgcacgcuccugaugaaugaacuggggguccccuuucaccucggaacaagacagguguguauugccuggagcuccagcucuugccaugauggcaaggcuuggcugcacguuugugugaccggcuaugacaaaaacgccacagcuuccuucaucuacgaugggcggcuugucgacagcauuggaucuuggucccagaauauccugcgcacccaagagagcgaaugcguguguauuaacggaaccugcacaguggucaugacggaugggucugccuccggcagagcggacaccaaaauccucuuuaucgaggagggcaagauuguucacaucagcccucuguccgggucugcccagcauguggaagagugcagcuguuauccccgguacccuggagugcgcugcauuuguagagauaauuggaagggcuccaaccggcccgucguggacaucaauguuaaagacuacagcauugauucuuccuaugugugcagcggccuugucggggacacaccgcgcaacaacgauagaucuagcaauuccuacugucggaacccuaauaacgaaaagggaaaucacggcgugaaagggugggcuuucgacgauggaaacgacguuuggaugggccgcaccaucucugaggauagcagauccggguaugaaacauuuaaggugaucggaggcuggagcacccccaauucuaaacugcagauuaaccggcaggucaucguggacuccgauaauagaagcggcuacucugggauuuucuccgucgagggaaagagcugcaucaaccgcuguuuuuauguggagcucauucggggcagagaacaagagacgcgcguuugguggacauccaauucuaucguggucuucugcgggaccagcggaaccuacggcacaggguccuggccugacggcgccgauauuaaccugaugcccaucuga

SEQ ID NO: 205008 - RNA, 1410 nt, Artificial Sequence
  derived and/or modified sequence opt5 from neuraminidase__InfluenzaA__AFG98943
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacauuagcccucuguccgggucugcccagcauguugaagagugcagcuguuauccccgguacccuggagugcgcugcaucuguagagauaacuggaagggcuccaaucggcccguggucgacauuaacgugaaggacuacagcaucgauucuuccuauguuugcagcggccuugugggggacacaccgcgcaaaaacgauagaucuagcaauuccuacugucggaacccuaauaacgaaaagggaaaucacggcgucaaagggugggcuuucgacgauggaaacgacguguggaugggccgcaccaucucugaggauagcagauccggguaugaaacauuuaagguuauuggaggcuggagcacccccaauucuaaacugcagaucaacagacaggugauugucgacuccgauaaucggagcggcuacucugggaucuucuccguggagggaaagagcugcauuaaccgcuguuuuuaugucgagcucauccggggcagagaacaagagacgcgcgugugguggacauccaauucuauuguuguguucugcgggaccagcggaaccuacggcacaggguccuggccugacggcgccgauaucgaccugaugcccaucuga

SEQ ID NO: 205009 - RNA, 1410 nt, Artificial Sequence
  derived and/or modified sequence opt5 from neuraminidase__InfluenzaA__AFG98965
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccacaaucauugagagaaacaucaccgaaauuguguaucugacaaauaucaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacauuagcccucuguccgggucugcccagcauguugaagagugcagcuguuauccccgguacccuggagugcgcugcaucuguagagauaacuggaagggcuccaaucggcccguggucgacauuaacgugaaggacuacagcaucgauucuuccuauguuugcagcggccuugugggggacacaccgcgcaacaaugauagaucuagcaacuccuacugucggaauccuaacaaugaaaaaggaaaccacggcgucaaggggugggcuuucgacgauggaaaugacguguggaugggccgcaccaucucugaggauagcagauccggguaugaaacauuuaaaguuauuggaggcuggagcacccccaacucuaagcugcagaucaauagacaggugauugucgacuccgauaaccggagcggcuacucugggaucuucuccguggagggaaaaagcugcauuaaucgcuguuuuuaugucgagcucauccggggcagagaacaagagacgcgcgugugguggacauccaacucuauuguuguguucugcgggaccagcggaaccuacggcgccggguccuggccugacggcgcugauaucaaucugaugcccaucuga

SEQ ID NO: 205010 - RNA, 1410 nt, Artificial Sequence
  derived and/or modified sequence opt5 from neuraminidase__InfluenzaA__AFG98976
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucuggcgaauaccacaauugagaaggaaaucuguccuaaacucgucgaguaccggaacuggagcaagccccagugcaaaauuaccggguucgcuccuuuuuccaaggauaauucuauccgccugagcgccggaggcgacaucugggugacgagagagcccuauguuuccugugauccugggaagugcuaccaauucgcccuuggacagggcaccacacuggacaacaaacauucuaaugauaccauucacgaccggacaccgcaucgcacccuccugaugaacgaacugggggugcccuuucaccucggaacgagacaggucuguaucgcuuggagcuccagcucuugccaugauggcaaggccuggcugcacguguguguuacaggcuaugacaaaaaugcuaccgccuccuucauuuacgaugggcggcuuguggacagcaucggaucuugguccaagaacauucugcgcacacaggagagcgaaugcgucuguaucaauggaaccugcaccguggugaugacagaugggucugcguccggcagagccgacacgaaaauccucuuuauugaggagggcaagaucguccacauuagcccucuguccgggucugcucaacauguugaagagugcagcuguuauccccgguacccuggagugcgcugcaucuguagagauaacuggaagggcuccaaucggcccguggucgacauuaacgugaaagacuacagcaucgauucuuccuauguuugcagcggccuugugggggacaccccgcgcaacaaugauagaucuagcuccucuuacugucggaacccuaauaacgaaaagggaaaucacggcgucaaagggugggccuucgacgauggaaacgacguguggaugggccgcacaaucagcgaggauuccagaagcggguaugaaaccuuuaagguuauuggaggcuggucuacacccaauuccaaacugcagaucaacagacaggugauugucgacagcgauaaucggucuggcuacuccgggguguucagcgucgagggaaaguccugcaucaaccgcuguuuuuauguggagcucauucggggcagagaacuggagacccgcguuugguggacgucuaauagcaucguggucuucugcgggacauccggaaccuacggcaccgggucuuggccugacggcgcugauauuaaccugaugcccaucuga

SEQ ID NO: 205011 - RNA, 1410 nt, Artificial Sequence; identical to SEQ ID NO: 205010
  derived and/or modified sequence opt5 from neuraminidase__InfluenzaA__AFG98987

SEQ ID NO: 205012 - RNA, 1410 nt, Artificial Sequence
  derived and/or modified sequence opt5 from neuraminidase__InfluenzaA__AFG98998
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggaaaacaaacauucuaaugacacaauucacgaucggaccccgcaucgcacgcuccugaugaacgagcugggggugcccuuucaccucggaacaagacaggucuguaucgccuggagcuccagcucuugccaugacggcaaggcuuggcugcacguguguguuaccggcuaugauaaaaaugccacagcuuccuucauuuacgacgggcggcuuguggauagcaucggaucuuggucccagaacauucugcgcacccaagaaagcgagugcgucuguaucaauggaaccugcacaguggugaugacggacgggucugccuccggcagagcggauaccaagauccucuuuauugaggaaggcaaaaucguccacauuagcccucuguccgggucugcccagcauguugaggaaugcagcuguuauccccgguacccuggagugcgcugcaucuguagagacaacuggaagggcuccaaucggcccguggucgauauuaacgugaaggacuacagcaucgacucuuccuauguuugcagcggccuugugggggauacaccgcgcaaaaacgacagaucuagcuccucuuacugucggaauccuaacaaugagaagggaaaccacggcgucaaagggugggcuuucgaugacggaaaugauguguggaugggccgcaccaucagcgaagacuccagaagcggguaugagacauuuaagguuauuggaggcuggucuacccccaacuccaaacugcagaucaauagacaggugauugucgauagcgccaaccggucuggcuacuccgggaucuucagcguggagggaaaguccugcauuaaucgcuguuuuuaugucgaacucauccggggcagagagcaagaaacgcgcgugugguggacaucuaacagcauuguuguguucugcgggaccuccggaaccuacggcacagggucuuggccugacggcgcugauaucaaucugaugcccaucuga

SEQ ID NO: 205013 - RNA, 1410 nt, Artificial Sequence; identical to SEQ ID NO: 205010
  derived and/or modified sequence opt5 from neuraminidase__InfluenzaA__AFG99009

SEQ ID NO: 205014 - RNA, 1410 nt, Artificial Sequence
  derived and/or modified sequence opt5 from neuraminidase__InfluenzaA__AFG99020
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacacaagcccucuguccgggucugcccagcauguugaagagugcagcuguuauccccgguacccuggagugcgcugcauuuguagagauaacuggaagggcuccaaucggcccguggucgacaucaacgugaaggacuacagcauugauucuuccuauguuugcagcggccuugugggggacaccccgcgcaacaaugauagaucuagcuccucuuacugucggaacccuaauaacgaaaaaggaacacacggcgucaaggggugggcuuucgacgauggaaaugacguguggaugggccgcaccaucagcgaggauuccagaagcggguaugaaacguuuaaaguuaucggaggcuggucuacacccaacuccaagcugcagauuaauagacaggugaucgucgacagcgauaaccggucuggcuacuccgggauuuucagcguggagggaaaauccugcaucaaucgcuguuuuuaugucgagcucauucggggcagagaacaagagacccgcgugugguggaccucuaacagcaucguuguguucugcgggacauccggaaccuacggcacagggucuuggccugacggcgccgauauuaauaucaugcccaucuga

SEQ ID NO: 205015 - RNA, 1410 nt, Artificial Sequence
  derived and/or modified sequence opt5 from neuraminidase__InfluenzaA__AFG99031
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacacaagcccucuguccgggucugcccagcauguugaagagugcagcuguuauccccgguacccuggagugcgcugcauuuguagagauaacuggcggggcuccaaucgccccguggucgacaucaacgugaaggacuacagcauugauucuuccuauguuugcagcggccuugugggggacaccccgagaaacaaugaucggucuagcuccucuuacugucgcaacccuaauaacgaaaagggaacacacggcgucaaagggugggcuuucgacgauggaaaugacguguggaugggcagaaccaucagcgaggauucccggagcggguaugaaacguuuaagguuaucggaggcuggucuacacccaacuccaaacugcagauuaauagacaggugaucgucgacagcgauaaccgcucuggcuacuccgggauuuucagcguggagggaaaguccugcaucaaucgguguuuuuaugucgagcucgugagaggccgcgaacaagagacccggguuugguggaccucuaacagcauuguggucuucugcgggacauccggaaccuacggcacagggucuuggccugacggcgccgauaucaaucugaugcccauuuga

SEQ ID NO: 205016 - RNA, 1410 nt, Artificial Sequence; identical to SEQ ID NO: 197600
  derived and/or modified sequence opt5 from neuraminidase__InfluenzaA__AFG99042

SEQ ID NO: 205017 - RNA, 1410 nt, Artificial Sequence
  derived and/or modified sequence opt5 from neuraminidase__InfluenzaA__AFG99053
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacacaagcucccugucugggagcgcccagcauguugaagagugcuccuguuauccucgguaccccggagugcgcugcauuuguagagauaacuggaagggcagcaaucggccuguggucgacaucaacgugaaggacuacucuauugauuccagcuauguuugcucuggccuugugggggacacaccccgcaacaaugauagaagcuccucuagcuacugucggaacccgaauaacgaaaaaggaacccacggcgucaaggggugggcuuucgacgauggaaaugacguguggaugggccgcaccaucuccgaggauagcagaucuggguaugaaacguuuaaaguuaucggaggcugguccauuccuaacagcaagcugcagaucaauagacaggugauugucgacucugauaaccgguccggcuacagcgggaucuucuccguggagggaaaaucuugcauuaaucgcuguuuuuaugucgagcucauccggggcagagaacaagagacacgcgugugguggaccagcaacuccauuguuguguucugcgggaccucuggaacauacggcaccgggagcuggcccgacggcgccgauaucaaucugaugccuaucuga

SEQ ID NO: 205018 - RNA, 1410 nt, Artificial Sequence
  derived and/or modified sequence opt5 from neuraminidase__InfluenzaA__AFG99064
augaaccccaaucagaagaucauuaccaucggcagcgugucccugacaauugccacggucugcuuccucaugcaaaucgcuauucugguuaccacagugacccuucacuuuaaacaguacgagugugacucuccuccgaacaaucaggugaugcccugcgaaccuaucaucauugagagaaacgucacagaaaucguguaucugaccaauacaaccauugagaaggaaaucugucccaaacucguugaguaccggaacuggagcaagccucagugcaaaauuacgggguucgcccccuuuuccaaggauaauucuauccgccugagcgcgggaggcgacauuugggugaccagagagccuuaugucuccugugauccgucuaagugcuaccaauucgcucuugggcagggaacaacccuggacaacaaacauagcaaugauacaauccacgaccggacgccccaucgcacccuccugaugaacgaacugggcgugccuuuucaccucgggacaagacagguuuguaucgccugguccuccucuuccugccaugauggaaaggccuggcugcacguguguauuaccggcuaugacaaaaaugcuacagccagcuucaucuacgauggccggcuugucgacucuauuggguccuggagcaagaacauccugcgcacccaggagucugaaugcguguguauuaauggaaccugcacaguggucaugacggauggcuccgcuagcgagagagccgacaccaaaauccucuuuaucgaggaagggaagauuguucacaucagcccccugucuggaagcgcgcaacauguggaggaaugcuccuguuauccucgguaccccggcgugcgcugcauuuguagagauaacuggaaggggagcaaucggccggucguggacaucaacguuaaagacuacucuauuguguccagcuaugucugcucuggacuugugggcgauacaccucgcaagaacgacagaagcuccucuagcuacugucggaaucccaacaaugagaaaggcaaccacgggguuaagggaugggccuucgaugacggcaaugauguguggauggggcgcaccaucuccgaagagagcagaucuggauaugagacauuuaaagucaucggcgggugguccaccccuaacagcaagcugcagauuaauagacaggugaucgucgacucugauaaccgguccggauacagcggcauuuucuccguggaaggcaaaucuugcaucaaucgcuguuuuuauguugagcucauucgggggagagaacaggagacgcgcgugugguggacaagcaacuccaucgucguguucugcggaaccucuggcaccuacgggacaggaagcuggcccgacggcgcugauauuaaucugaugcccaucuga

SEQ ID NO: 205019 - RNA, 1410 nt, Artificial Sequence
  derived and/or modified sequence opt5 from neuraminidase__InfluenzaA__AFG99086
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacgugacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggaccccguaucgcacgcuccugaugaacgaacuggggguccccuuucaucucggaacaagacagguguguauugccuggagcuccagcucuugccacgauggcaaggcuuggcugcauguuugugugaccggcuacgacaaaaaugccacagcuuccuucaucuaugaugggcggcuugucgacagcauuggaucuugguccaagaacauccugcgcacccaggagagcgaaugcguguguauuaaugggaccugcacaguggucaugacggauggcucugccuccgagagagcggacaccaaaauccucuuuaucgaggaaggaaagauuguucacaucagcccucuguccggcucugcccaacacguggaggaaugcagcuguuacccccgguacccuggggugcgcugcauuuguagagauaacuggaagggauccaaucggcccgucguggacaucaacguuaaagacuauagcauugugucuuccuacgucugcagcggccuugugggcgauacaccgcgcaagaacgacagaucuagcuccucuuauugucggaauccuaacaaugagaaagggaaccauggaguuaagggcugggcuuucgaugacgggaaugauguguggaugggacgcaccaucagcgaagaguccagaagcggcuacgagacauuuaaagucaucgggggauggucuacccccaacuccaagcugcagauuaauagacaggugaucgucgacagcgauaaccggucuggcuauuccggcauuuucagcguggaagggaaauccugcaucaaucgcuguuuuuacguugagcucauucggggaagagaacaggagacgcgcgugugguggacaucuaacagcaucgucguguucugcggcaccuccgggaccuauggaacaggcucuuggccugacggggccgauauuaaucugaugcccaucuga

SEQ ID NO: 205020 - RNA, 1410 nt, Artificial Sequence
  derived and/or modified sequence opt5 from neuraminidase__InfluenzaA__AFG99097
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacgugacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggaccccguaucgcacgcuccugaugaacgaacuggggguccccuuucaucucggaacaagacagguguguauugccuggagcuccagcucuugccacgauggcaaggcuuggcugcauguuugugugaccggcuacgacaaaaaugccacagcuuccuucaucuaugaugggcggcuugucgacagcauuggaucuugguccaagaacauccugcgcacccaggagagcgaaugcguguguauuaaugggaccugcacaguggucaugacggauggcucugccuccgagagagcggacaccaaaauccucuuuaucgaggaaggaaagauuguucacaucagcccucuguccggcucugcccaacacguggaggaaugcagcuguuacccccgguacccuggggugcgcugcauuuguagagauaacuggaagggauccaaucggcccgucguggacaucaacguuaaagacuauagcauugugucuuccuacgucugcagcggccuugugggcgauacaccgcgcaagaacgacagaucuagcuccucuuauugucggaauccuaacaaugagaaagggaaccauggaguuaagggcugggcuuucgaugacgggaaugauguguggaugggacgcaccaucagcgaagaguccagacugggcuacgagacauuuaaagucaucgggggauggagcacccccaacucuaagcuccagauuaauagacaggugaucgucgacuccgauaaccggagcggcuauucuggcauuuucuccguggaagggaaaagcugcaucaaucgcuguuuuuacguugagcugauucggggaagagaacaggagacgcgcgugugguggacauccaacucuaucgucguguucugcggcaccagcgggaccuauggaacaggcuccuggccugacggggccgauauuaaucugaugcccaucuga

SEQ ID NO: 205021 - RNA, 1410 nt, Artificial Sequence
  derived and/or modified sequence opt5 from neuraminidase__InfluenzaA__AFG99119
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacccccuaucgcacgcuccugaugaacgaacugggggugccuuuucaucucggaacaagacaggucuguaucgccugguccuccucuuccugccacgacggcaaggccuggcugcauguguguguuaccggccacgauaaaaaugcuacagccagcuucauuuacgacgggcggcuuguggauucuaucggauccuggagcaagaacauucugcgcacccaggagucugaaugcgucuguaucaaugggaccugcacaguggugaugacggacggcuccgcuagcgagagagccgauaccaaaauccucuuuauugaggaaggaaagaucguccacauuagcccccugucuggcagcgcgcaacauguugaggaaugcuccuguuauccucgguaccccggggugcgcugcguguguagagacaacuggaagggaagcaaucggccgaucgucgauauuaacgugaaagacuacucuaucguuuccagcuaugugugcucuggccuugucggcgacacaccucgcaagaacgauagaagcuccucuagcuacugucggaaucccaacaaugagaaagggaaccacggagugaagggcugggccuucgacgaugggaaugacguuuggaugggacgcaccaucuccgaagagagcagaucuggcuaugagacauuuaaagugauugggggaugguccaccccuaacagcaagcugcagaucaaucggcaggucauuguggauucugacaacagauccggcuacagcggcaucuucuccgucgaagggaaaucuugcauuaaucgcuguuuuuauguggagcucauccggggaagagaacaggagacgcgcguuugguggacaagcaacuccauuguggucuucugcggcaccucugggaccuacggaacaggcagcuggcccgauggggcugacaucaaucugaugcccaucuga

SEQ ID NO: 205022 - RNA, 1410 nt, Artificial Sequence
  derived and/or modified sequence opt5 from neuraminidase__InfluenzaA__AFG99130
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgggccuaucauuaucgaaagaaacauuacagagaucguguaucugaccaauacaaccauugaaaaggagaucugucccaaacucgucgaauaccggaacugguccaagccucagugcaaaauuacgggauucgcccccuuuucuaaggacaauagcauccgccuguccgcgggcggggauaucugggugaccagagagccuuauguuucuugugacccgggaaagugcuaccaauucgcucuuggccaggggacaacccuggauaacaaacauagcaaugacacaauucacgaucggacccccuaucgcacgcuccugaugaacgagcugggagugccuuuucaucucggcacaagacaggucuguaucgccugguccuccucuuccugccacgacggcaaggccuggcugcauguguguguuaccgggcacgauaaaaaugcuacagccagcuucauuuacgacggacggcuuguggauucuaucggcuccuggagcaagaacauucugcgcacccaggaaucugagugcgucuguaucaaugggaccugcacaguggugaugacggacggauccgcuagcgaaagagccgauaccaaaauccucuuuauugaggagggcaagaucguccacauuagcccccugucugggagcgcgcaacauguugaagagugcuccuguuauccucgguaccccggagugcgcugcguguguagagacaacuggaagggcagcaaucggccggucguggauaucaacguuaaagacuacucuauuguguccagcuaugucugcucuggccuugugggggacacaccucgcaagaacgauagaagcuccucuagcuacugucggaaucccaacaaugaaaaaggaaaccacggcguuaaggggugggccuucgacgauggaaaugacguguggaugggccgcaccaucuccgaggaaagcagaucuggguaugagacauuuaaagucaucggaggcugguccaccccuaacagcaagcugcagacgaauagacaggugauugucgauucugacaaccgguccggcuacagcgggaucuucuccguggagggaaaaucuugcauuaaucgcuguuuuuauguugaacucauccggggcagagagcaggaaacacgcgugugguggaccagcaacuccauugucguguucugcgggaccucuggaacauacggcaccgggagcuggcccgauggcgcugacaucaaucugaugcccauuuga

SEQ ID NO: 205023 - RNA, 1410 nt, Artificial Sequence
  derived and/or modified sequence opt5 from neuraminidase__InfluenzaA__AFG99141
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacccccuaucgcacgcuccugaugaacgaacugggggugccuuuucaucucggaacaagacaggucuguaucgccugguccuccucuuccugccacgacggcaaggccuggcugcauguguguguuaccggccacgauaaaaaugcuacagccagcuucauuuacgacgggcggcuuguggauucuaucggauccuggagcaagaacauucugcgcacccaggagucugaaugcgucuguaucaaugggaccugcacaguggugaugacggacggcuccgcuagcgagagagccgagaccaaaauccucuuuauugaagagggaaagaucguccacauuagcccccugucuggcagcgcgcaacauguugaagagugcuccuguuauccucgguaccccggggugcgcugcguguguagagauaacuggaagggaagcaaucggccggucguggacaucaacguuaaagauuacucuauuguguccagcuaugucugcucuggccuugugggcgacacaccucgcaagaacgacagaagcuccucuagcuacugucggaaucccaacaaugaaaaagggaaccacggaguuaagggcugggccuucgaugacgggaaugauguguggaugggacgcaccaucuccgaggagagcagaucuggcuaugaaacauuuaaagucaucgggggaugguccaccccuaacagcaagcugcagauuaauagacaggugaucgucgacucugauaaccgguccggcuacagcggcauuuucuccguggaggggaaaucuugcaucaaucgcuguuuuuauguugaacucauucggggaagagagcaggaaacgcgcgugugguggacaagcaacuccaucgucguguucugcggcaccucugggaccuacggaacaggcagcuggcccgacggggcugauauuaaucugaugcccaucuga

SEQ ID NO: 205024 - RNA, 1410 nt, Artificial Sequence
  derived and/or modified sequence opt5 from neuraminidase__InfluenzaA__AFG99152
augaaccccaaucagaagaucaugaccauuggcagcgugucccugacaaucgccacgauuugcuuccucaugcaaaucgcuauucuggucaccacaguuacccuucacuuuaaacauuacgaguucucuagcccuccgaacaaucaggugaugcccugugaaccuaucaucauugagagaaacaucacagaaauuguguaucugaccaauacaaccaucgagaaggaagucugccccaaacucguggaguaccggaacugguccaagccucaguguaaaauuacgggguuugcccccuucucuaaggacaauagcauccgccuguccgcgggaggcgauauuuggguuaccagagagccuuaugugucuugcgacccggggaaguguuaccaguuugcucuuggacaaggcacaacccugaacaauaaacacagcaacgauacaauccaugaccggacccccuaucgcacgcuccugaugaaugaacugggggucccuuuccaccucggaacaagacaggugugcaucgccugguccuccucuuccugucaugauggcaaggccuggcugcacguuugcgugaccggccacgacaaaaacgcuacagccagcuuuauuuacgaugggcggcuugucgacucuaucggauccuggagcaagaauauucugcgcacccaggagucugaaugugugugcaucaacggcaccuguacaguggucaugacggauggguccgcuagcggacgggccgacaccaaaauucucuucaucgaggagggcaagaucguucauauuagcccccugucugggagcgcgcagcacguggaagagugcuccugcuauccucgguaccccggagugcgcugugucugcagagauaauuggaagggcagcaaccggccgaucguggacauuaacguuaaagauuacucuaucguguccagcuaugucuguucuggccuugugggggacacaccucgcaagaaugacagaagcuccucuagcuacugccggaaccccaauaacgaaaaaggaaaucauggcguuaaggggugggccuuugaugacggaaacgauguguggaugggccgcaccauuggggaggaacugagauccggauaugagacauucaaagucaucggcggcuggagcaccccuaauucuaagcuccaaaucaacagacaggugauugucgacuccgauaauagaagcggguacucuggaaucuuuuccguggagggcaaaagcuguauuaaccgcugcuucuauguugaacugauccgggggagagagcaggaaacgcgcgugcuguggacauccaauucuauugucguguuuuguggaaccagcggcaccuacgggacaggcuccuggcccgacggagcugauaucaaccucaugcccauuuga

SEQ ID NO: 205025 - RNA, 1410 nt, Artificial Sequence; identical to SEQ ID NO: 202019
  derived and/or modified sequence opt5 from neuraminidase__InfluenzaA__AFG99163

SEQ ID NO: 205026 - RNA, 1410 nt, Artificial Sequence
  derived and/or modified sequence opt5 from neuraminidase__InfluenzaA__AFG99174
augaaccccagccagaagaucauuaccaucggcuccgugucucugacaauugccacgaucugcuuccucaugcaaauugcuauccuggucaccacaguuacccuucacuuuaaacaguacgaguguagcuccccuccgaauaaccaggugaugcccugcgaaccuaucauuaucgagagaaauauuacagaaaucguguaucugaccaacacaaccauugagaaggaaaucugucccaaacucauggaguaccggaauuggucuaagccucagugcaaaauuacgggguucgcccccuuuagcaaggacaacuccauccgccugucugcgggaggcgauaucugggucaccagagagccuuaugugagcugugacccggggaagugcuaccaauucgcucuuggacagggcacaacccuggauaauaaacauuccaacgacacaauucacgaucggacccccuaucgcacgcuccugaugaaugaacuggggguuccuuuucaucucggaacaagacagguguguaucgccuggucuagcuccagcugccacgacggcaaggccuggcugcaugucugugugaccggccacgauaaaaacgcuacagccucuuucauuuacgacgggcggcuuguugauuccaucggaagcuggucuaagaauauucugcgcacccaggaguccgaaugcguguguaucaacgggaccugcacagucgugaugacggacggcagcgcuuccgagagagccgagaccaaaauccucuuuauugaagagggaaagaucgugcacauuucuccccugagcggcuccgcgcaacaugucgaagagugcagcuguuauccucgguaccccgggguucgcugcguguguagagauaauuggaagggaucuaaccggccgguggucgacaucaaugugaaagauuacuccauuguuagcucuuaugugugcagcggccuugucggcgacacaccucgcaagaacgacagauccucuagcuccuacugucggaaccccaauaacgaaaaagggaaucacggagugaagggcugggccuucgaugacgggaacgauguuuggaugggacgcaccaucagcgaggagucuagauccggcuaugaaacauuuaaagugaucgggggauggagcaccccuaauucuaagcugcagauuaaccggcaggucaucguggacuccgauaauagaagcggcuacuccggcauuuucucugucgaggggaaaagcugcaucaaccgcuguuuuuauguggaacucauucggggaagagagcaggaaacgcgcguuugguggacauccaauucuaucguggucuucugcggcaccagcgggaccuacggaacaggcuccuggcccgacggggcugauauuaaccugaugcccaucuga

SEQ ID NO: 205027 - RNA, 1410 nt, Artificial Sequence
  derived and/or modified sequence opt5 from neuraminidase__InfluenzaA__AFG99185
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccugaacaauaaacauagcaacgauacaauucacgaccggacccccuaucgcacgcuccugaugaaugaacugggggugccuuuucaucucggaacaaagcaggucuguaucgccugguccuccucuuccugccacgauggcaaagccuggcugcauguguguguuaccggccacgacaagaacgcuacagccagcuucauuuacgaugggagacuuguggacucuaucggauccuggagcaaaaauauucugcggacccaggagucugaaugcgucuguaucaacgggaccugcacaguggugaugacggauggcuccgcuagcgagcgcgccgacaccaagauccucuuuauugaggaaggaaagaucguccacauuagcccccugucuggcagcgcgcaacauguugaggaaugcuccuguuauccuagauaccccggggugcggugcgugugucgcgauaauuggaaaggaagcaacagaccgaucgucgacauuaacgugaaggauuacucuaucguuuccagcuaugugugcucuggccuugucggcgacacaccucggaaaaaugaccgcagcuccucuagcuacuguagaaaccccaauaacgagaaggggaaucacggagugaaaggcugggccuucgaugacgggaacgauguuuggaugggacggaccaucggcgaggaacugcgcuccggguaugagacauuuaaggugauuggaggcuggagcaccccuaauucuaaacuccagaucaacagacaggucauuguggacuccaagaaucggagcggcuacucugggaucuucuccgucgaaggaaagagcugcauuaacagauguuuuuauguggagcugauccgcggccgggaacaggagacgagaguuugguggacauccaauucuauuguggucuucugcgggaccagcggaaccuacggcacaggguccuggcccgauggcgcugacaucaaccugaugcccaucuga

SEQ ID NO: 205028 - RNA, 1410 nt, Artificial Sequence
  derived and/or modified sequence opt5 from neuraminidase__InfluenzaA__AFG99196
augaaccccaaucagaagaucauuaccaucggcagcgugucccugacaauugccacgaucugcuuccucacccaaauugcuauccuggucacaaccguuacacuucacuuuaaacaguacgaguguucuagcuccccuaacaaucaggugaugccgugcgaacccaucauuaucgagagaaacauuaccgaaaucguguaucugacaaauaccacgauugagaaggaaaucuguccuaaacucgucgaguaccggaacuggucuaagccccagugcaaaauuaccggguucgccccuuuuagcaaggacaauuccauccgccugucugcgggaggcgauaucugggugacaagagagcccuauguuagcugugacccugggaagugcuaccaauucgcucuuggacagggcaccacacugaacaauaaacauuccaacgauaccauucacgaccggacgccguaucgcacacuccugaugaaugaacugggggugcccuuucaucucggaaccaagcaggucuguaucgccuggucuagcuccagcugccacgauggcaaagccuggcugcauguguguauuacaggccacgacaagaacgcuaccgccucuuucaucuacgaugggagacuuguugacuccauuggaagcuggucuaaaaauauccugcggacccaggaguccgaaugcguguguaucaacggcacaugcacggucgugaugaccgaugggagcgcuuccgagcgcgccgacacaaagauucucuuuaucgaggaaggaaagauugugcacaucucuccucugagcggcuccgcgcaacaugucgaggaaugcagcuguuaucccagauacccugggguucggugcgugugucgcgauaauuggaaaggaucuaacagacccauuguggacaucaacgucaaggauuacuccaucgugagcucuuauguuugcagcggccuugugggcgacaccccgcggaaaaaugaccgcuccucuagcuccuacuguagaaacccuaauaacgagaaggggaaucacggagucaaaggcugggccuucgaugacgggaacgauguguggaugggacggacaauuggcgaggaacugcgcagcggguaugagaccuuuaagguuaucggaggcuggucuacgcccaauuccaaacuccagauuaacagacaggugaucgucgacagcggcaaucggucuggguacuccggaauuuucagcguggaaggcaaguccugcaucaacagauguuuuuaugucgagcugauucgcgggcgggaacaggagacaagagugugguggaccucuaauagcaucguuguguucugcggaaccuccggcacauacgggaccggcucuuggccugauggagcugacaucaaccugaugcccauuuga

SEQ ID NO: 205029 - RNA, 1410 nt, Artificial Sequence
  derived and/or modified sequence opt5 from neuraminidase__InfluenzaA__AFG99207
augaaccccaaucagaagaucauuaccaucggcagcgugucccugacaauugccacgaucugcuuccucaugcaaauugcuauccuggucaccacaguuacccuucacuuuaaaccuuacgaguguucuagcccgcccaacaaucaggugaugccuugcgaacccaucauuaucgagagaaacauuacagaaaucguguaucugaccaauacaaccauugagaaggaaaucuguccuaaacucgucgaguaccggaacugguccaagccccagugcaaaauuacgggguucgccccuuuuucuaaggacaauagcauccgccuguccgcgggaggcgauaucugggugaccagagagccguauguuucuugugaccccgggaagugcuaccaguucgcucuuggacaaggcacaacccugaacaauaaacauagcaacgauacaauucacgaccggaccccuuaucgcacgcuccugaugaaugaacugggggugcccuuucaucucggaacaaagcaggucuguaucgccugguccucuagcuccugccacgauggcaaagccuggcugcauguguguguuaccggccacgacaagaacgcuacagccagcuucauuuacgaugggagacuuguggacucuaucggauccuggagcaaaaauauucugcggacccaggagucugaaugcgucuguaucaacgggaccugcacaguggugaugacggauggcuccgcuagcgagcgcgccgacaccaagauccucuuuauugaggaaggaaagaucguccacauuuccccucugucuggcagcgcgcagcauguugaggaaugcuccuguuaucccagauacccgggggugcggugcgugugucgcgauaauuggaaaggaagcaacagaccuaucgucgacauuaacgugaaggauuacucuaucguuuccagcuaugugugcucuggccuugucggcgacacaccccggaaaaaugaccgcagcuccucuagcuacuguagaaacccuaauaacgagaaggggaaucacggagugaaaggcugggccuucgaugacgggaacgauguuuggaugggacggaccaucggcgaggaacugcgcuccggguaugagacauuuaaggugauuggaggcuggagcacccccaauucuaaacuccaaaucaacagacaggucauuguggacuccaagagccggucuggcuacuccgggaucuucagcgucgaaggaaaguccugcauuaauagauguuuuuauguggagcugauccgcggccgggaacaggagacgagaguuugguggacaucuaacagcauuguggucuucugcgggaccuccggaaccuacggcacagggucuuggcccgauggcgcugacaucaaucugaugccuaucuga

SEQ ID NO: 205030 - RNA, 1410 nt, Artificial Sequence; identical to SEQ ID NO: 197838
  derived and/or modified sequence opt5 from neuraminidase__InfluenzaA__AFG99218

SEQ ID NO: 205031 - RNA, 1410 nt, Artificial Sequence
  derived and/or modified sequence opt5 from neuraminidase__InfluenzaA__AFG99229
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacaaagaucguguaucugaccaauacaaccauugaaaaagagaucugucccaagcucgucgaauaccggaacugguccaaaccucagugcaagauuacgggguucgcccccuuuucuaaggacaauagcauccgccuguccgcgggaggcgauaucugggugaccagagagccuuauguuucuugugacccggggaaaugcuaccaauucgcucuuggacagggcacaacccugaacaauaagcauagcaacgauacaauucacgaccggacccccuaucgcacgcuccugaugaaugagcugggggugccuuuucaucucggaacaaaacaggucuguaucgccugguccuccucuuccugccacgauggcaaggccuggcugcauguguguguuaccggccacgacaaaaacgcuacagccagcuucauuuacgaugggagacuuguggacucuaucggauccuggagcaagaauauucugcggacccaggaaucugagugcgucuguaucaacgggaccugcacaguggugaugacggauggcuccgcuagcgaacgcgccgacaccaagauccucuuuauugaggagggaaaaaucguccacauuagcccccugucuggcagcgcgcaacauguugaagagugcuccuguuauccuagauaccccggggugcggugcgugugucgcgauaauuggaagggaagcaacagaccgaucgucgacauuaacgugaaagauuacucuaucguuuccagcuaugugugcucuggccuugucggcgacacaccucggaagaaugaccgcagcuccucuagcuacuguagaaaccccaauaacgaaaaagggaaucacggagugaagggcugggccuucgaugacgggaacgauguuuggaugggacggaccaucggcgaggaacugcgcuccggguaugagacauuuaaagugauuggaggcuggagcaccccuaauucuaagcuccagaucaacagacaggucauuguggacuccaagaaucggagcggcuacucugggaucuucuccgucgagggaaaaagcugcauuaacagauguuuuuauguggaacugauccgcggccgggagcaggaaacgagaguuugguggacauccaauucuauuguggucuucugcgggaccagcggaaccuacggcacaggguccuggcccgauggcgcugacaucaaccugaugcccaucuga

SEQ ID NO: 205032 - RNA, 1410 nt, Artificial Sequence
  derived and/or modified sequence opt5 from neuraminidase__InfluenzaA__AFG99240
augaaccccaaucagaagaucauuaccaucggcagcgugucccugacaauugccacgaucugcuuccucaugcaaauugcuauccuggucaccacaguuacccuucacuuuaaacaguacgaguguucuagcccuccguccaaccaggugaugcccugcgaaccuaucauuaucgagagaaauauuacagaaaucguguaucugaccaacacaaccauugagaaggaaaucugucccaaaccugucgaguaccggaauuggucuaagccccagugcaaaauuacgggguucgccccuuuuagcaaggacaacuccauccgccucucugcgggaggcgauaucugggugaccagagagccguauguuagcugugaccccgggaagugcuaccaauucgcucugggacagggcacaacccuuaauaacaaacauuccaaugauacaauucacgaccggaccccuuaucgcacgcugcucaugaacgaacugggggugcccuuucaucugggaacaaagcaggucuguaucgccuggucuagcuccagcugccacgauggcaaagccuggcuccauguguguguuaccggccacgacaagaaugcuacagccucuuucauuuacgaugggagacugguggacuccaucggaagcuggucuaaaaacauucuucggacccaggaguccgaaugcgucuguaucaaugggaccugcacaguggugaugacggauggcagcgcuuccgagcgcgccgacaccaagauccuguuuauugaggaaggaaagaucguccacauuucuccucucagcggcuccgcgcaacauguugaggaaugcagcuguuaucccagauacccgggggugcggugcgugugucgcgauaacuggaaaggaucuaauagaccuaucgucgacauuaacgugaaggauuacuccaucguuagcucuuaugugugcagcggccuggucggcgacacaccccggaaaaacgaccgcuucuccucuagcuacuguagaaauccuaacaaugagaaggggaaccacggagugaaaggcugggccuuugaugacgggaaugauguuuggaugggacggaccaucggcgaggaacuucgcuccggguaugagacauucaaggugauuggaggcuggagcacccccaacucuaaacugcagaucaauagacaggucauuguggacuccaagaaccggagcggcuacucugggaucuuuuccgucgaaggaaagagcugcauuaauagauguuucuauguggagcucauccgcggccgggaacaggagacgagaguuugguggacauccaacucuauuguggucuuuugcgggaccagcggaaccuacggcacaggguccuggcccgauggcgcugacaucaaucugaugccuaucuga

SEQ ID NO: 205033 - RNA, 1410 nt, Artificial Sequence; identical to SEQ ID NO: 197837
  derived and/or modified sequence opt5 from neuraminidase__InfluenzaA__AFG99251

SEQ ID NO: 205034 - RNA, 1410 nt, Artificial Sequence
  derived and/or modified sequence opt5 from neuraminidase__InfluenzaA__AFG99273
augaaccccaaucagaagaucauuaccaucggcagcgugucccugacaauugccacgaugugcuuccucaugcaaaucgcuauucuggucaccacaguuacccuucacuuuaaacaguacgaguguucuagcccuccgaacaaucaggugaugcccugcgaaccuacaaucaucgagagaaacauuaccgaaaucguguaucugacaaauaccacgauugagaaggaaaucugucccaaacucgucgaguaccggaacugguccaagccucagugcaaaauuaccggguucgcccccuuuucuaaggacaauagcauccgccuguccgcgggaggcgauauuugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucaucuacgaugggcggcuugucgacucuauuggauccuggagcaagaauauccugcgcacccaggagucugaaugcguguguauuaacggcacaugcacgguggucaugaccgauggguccgcuagcgagagagccgacacaaaaauccucuuuauugaggaaggaaagaucguucacaucagcccccugucuggcagcgcgcaacauguggaggaaugcuccuguuauccucgguaccccggggugcgcugcgucuguagagauaauuggaagggaagcaaccggccgauuguggacaucaacguuaaagauuacucuauuguguccagcuaugucugcucuggccuugugggcgacaccccucgcaagaaugacagaagcuccucuagcuacugucggaaccccaauaacgagaaagggucccacggaguuaagggcugggccuucgaugacgggaaugauguguggaugggacgcacaaucggcgaggaacugagaagcggguaugagaccuuuaaagucauuggaggcuggucuacgccuaacuccaagcuccagaucaauagacaggugaucgucgacagcggcaaccggucuggguacuccggaauuuucagcguggaaggcaaauccugcaucaaucgcuguuuuuauguugagcugauucgggggagagaacaggagacacgcgugugguggaccucuaacagcaucgucguguucugcggaaccuccggcacauacgggaccggcucuuggcccgauggagcugacauuaaucugaugcccaucuga

SEQ ID NO: 205035 - RNA, 1410 nt, Artificial Sequence
  derived and/or modified sequence opt5 from neuraminidase__InfluenzaA__AFG99284
augaaccccaaucagaagaucauuaccaucggcagcgugucccugacaauugccacgaucugcuuccucaugcaaauugcuauccuggucaccacaguuacccuucacuuuaaacaguacgaguguucuagcccuccguccaaccaggugaugcccugcgaaccuaucauuaucgagagaaauauuacaaagaucguguaucugaccaacacaaccauugaaaaagagaucugucccaagcucgucgaauaccggaauuggucuaaaccucagugcaagauuacgggguucgcccccuuuagcaaggacaacuccauccgccugucugcgggaggcgauaucugggugaccagagagccuuauguuagcugugacccguccaaaugcuaccaauucgcucuugggcagggaacaacccugaauaacaagcauagcaaugauacaauucacgaccggacccccuaucgcacgcuccugaugaacgagcugggcgugccuuuucaucucgggacaaaacaggucuguaucgccuggucuuccagcucuugccacgauggaaaggccuggcugcauguguguguuaccggccacgacgauaaugcuacagccuccuucauuuacgacggcagacuuguggauagcaucgggucuugguccaaaaacauucugcggacccaggaaagcgagugcgucuguaucaauggaaccugcacaguggugaugacggacggcuccgcuucugaacgcgccgauaccaagauccucuuuauugaggaggggaagaucguccacauuagcccccuguccggaagcgcgcaacauguugaagagugcucuuguuauccuagauaccccggcgugcggugcgugugucgcgacaacuggaaaggguccaauagaccgaucgucgauauuaacgugaaggacuacagcaucguuucuagcuaugugugcuccggacuugucggcgacacaccucggaaaaacgaucgcucuagcuccagcuacuguagaaaucccaacaaugaaaagggcucucacggggugaaaggaugggccuucgacgauggcaacgacguuuggauggggcggaccaucggagaggaacugcgcuccggcuaugagacauuuaaggugauugggggauggagcaccccuaauucuaaacuccagaucaacagacaggucauuguggauuccaagaaucggagcggcuacuccggcaucuucucugucgagggaaagagcugcauuaacagauguuuuuauguggaacugauccgcgggcgggagcaggaaacgagaguuugguggacauccaauucuauuguggucuucugcggcaccagcgggaccuacggaacaggcuccuggcccgacggggcugauaucaaccugaugcccaucuga

SEQ ID NO: 205036 - RNA, 1410 nt, Artificial Sequence
  derived and/or modified sequence opt5 from neuraminidase__InfluenzaA__AFG99295
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggauaagugcuaccaauucgcucuugggcagggaaccacacugaacaaucggcauagcaacgacaccgugcacgaucgcacgcccuauagaacacuccugaugaaugaacugggcgucccuuuucaucucgggaccaaacagguguguaucgccugguccuccucuuccugccacgacggaaaggccuggcugcauguuugugugacaggccacgauaaaaacgcuaccgccagcuucauuuacaauggccggcuugucgacucuaucggguccuggagcaagaacauucugcgcacccaggagucugaaugcguguguaucaauggaacaugcacgguggucaugaccgauggcuccgcuagcgagagagccgacacaaaaauucucuuuaucgaggaagggaagaucguucacauuagcccccugucuggaagcgcgcaacauguggaggaaugcuccuguuauccucgguaccccggcgugcgcugcgucuguagagauaacuggaaggggagcaaccggccgaucguggacauuaauguuaaagauuacucuaucauuuccagcuaugugugcucuggacuugucggcgacaccccucgcaagaacgacagaagcuccucuagcuacugucagaaucccaacaaugagaaaggcucccacggggugaagggaugggccuucgaugacggcaacgauguuuggauggggcggacaaucggagaggaacugcgcagcggcuaugagaccuuuaaagugaucgggggauggucuacgccuaauuccaagcuccagauuaacagacaggucaucguggacagcggcaaucggucuggcuacuccgggauuuucagcgucgaaggaaaauccugcaucaacagauguuuuuauguggagcugauucgcggccggaagcaagaaacaagaguuugguggaccucuaauagcaucguggucuucugcgggaccuccggaacauacggcaccgggucuuggcccgauggcgcugacauuaaccugaugcccaucuga

SEQ ID NO: 205037 - RNA, 1410 nt, Artificial Sequence
  derived and/or modified sequence opt5 from neuraminidase__InfluenzaA__AFG99317
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaauaucaccggguucgcccccuuuucuaaagacaacagcauucgccuguccgcgggaggcgauaucugggugacaagagagccuuauguuucuugugacccggggaagugcuaccaauucgcucuuggacagggcaccacacugaauaaccggcauagcaaugauaccgugcacgaccgcacgcccuauagaacacuccugaugaacgaacugggggucccuuuucaucucggaaccaaacagguguguaucgccugguccuccucuuccugccacgauggcaaggccuggcugcauguuugugugacaggccacgacgagaaugcuaccgccagcuucauuuacgaugggcggcuugucgacucuaucggauccuggagcaagaacauucugcgcacccaggaaucugagugcguguguaucaauggcacaugcacgguggucaugaccgauggguccgcuagcgagagagccgacacaaaaauucucuuuaucgaagagggaaagaucguucacauuagcccccugucuggcagcgcgcaacauguggaagagugcuccuguuauccucgguaccccggggugcgcugcgucuguagagauaacuggaaaggaagcaaccggccgaucguggacauuaauguuaaggauuacucuaucguguccagcuaugucugcucuggccuugugggcgacaccccucgcaagaacgacagaagcuccucuagcuacugucggaaucccaacaaugaaaaagggucccacggaguuaagggcugggccuucgaugacgggaacgauguguggaugggacgcacaauugacgaggagcugagaagcggcuaugaaaccuuuaaagucaucgggggauggucuacgccuaauuccaagcuccagaucaacagacaggugauugucgauagcggcaaucggucuggcuacuccgggaucuucagcguggagggaaaauccugcauuaaccgcuguuuuuauguugaacugauccggggcagaaagcaggagacacgcgugugguggaccucuaauagcauugucguguucugcgggaccuccggaacauacggcaccgggucuuggcccgacggcgcugauaucaaccugaugcccauuuga

SEQ ID NO: 205038 - RNA, 1410 nt, Artificial Sequence
  derived and/or modified sequence opt5 from neuraminidase__InfluenzaA__AFG99328
augaaccccaaucagaagaucauuaccaucggcagcgugucccugacacucgccacgauuugcuuccugaugcaaaucgcuauucuugucaccacaguuacccugcacuuuaaacaguacgaguguucuagcccuccgaacaaucaggugaugcccugcgaaccuacaaucaucgagagaaacauuaccgaaaucguguaucucacaaauaccacgauugagaaggaaaucugucccaaacuggucgaguaccggaacugguccaagccucagugcaaaauuaccggguucgcccccuuuucuaaggacaauagcauccgccuuuccgcgggaggcgauauuugggugacaagagagccuuauguuucuugugacccgagcaagugcuaccaauucgcucuggggcagggaaccacacucaacaaucggcauuccaacgauaccgugcacgaccgcacgcccuauagaacacugcugaugaaugaacucggcgucccuuuucaucuggggacccgccagguguguauggccuggucuagcuccagcugccacgauggaaaagccuggcuucauguuugugugacaggccacgacgagaacgcuaccgccucuuucaucuacgauggccggcuggucgacuccaucgggagcuggucuaagaaugugcucagaacccaggaauccgagugcguguguauuaacggaacaugcacggucguuaugaccgauggcagcgcuuccgagcgggccgacacaaaaauccuguuuauugaagaggggaagaucgugcacauuucuccccuuagcggaaaugcgcaacauguggaagagugcuccuguuauccucgcuaccccggcgucagaugcgugugucgggauaacuggaaagggagcaaccgcccgaucguugacaucaaugugaaggauuacucuauugucuccagcuaugugugcucuggacugguuggcgacaccccuagaaagaacgaccggagcuccucuagcuacugucgcaaucccaacaaugaaaaaggcucccacggggugaagggaugggccuucgaugacggcaacgaugucuggauggggagaacaaucggagaggagcuccggagcggcuaugaaaccuuuaaagugauugggggauggucuacgccuaauuccaagcugcagaucaacagacaggucauuguggacagcggcaaucgcucuggcuacuccgggaucuucagcguugagggaaaauccugcaucaaccgguguuuuuauguggaacugauuagaggccgcaagcaggagacacgggucugguggaccucuaauagcaucgugguuuucugcgggaccuccggaacauacggcaccgggucuuggcccgauggcgcugacauuaaccucaugcccaucuga

SEQ ID NO: 205039 - RNA, 1410 nt, Artificial Sequence
  derived and/or modified sequence opt5 from neuraminidase__InfluenzaA__AFG99350
augaaccccaaucagaagaucauuaccaucggcagcgugucccugacacucgccacgauuugcuuccugaugcaaaucgcuauucuugucaccacaguuacccugcacuuuaaacaguacgaguguucuagcccuccgaacaaucaggugaugcccugcgaaccuacaaucaucgagagaaacauuaccgaaaucguguaucucacaaauaccacgauugagaaggaaaucugucccaaacuggucgaguaccggaacugguccaagccucagugcaaaauuaccggguucgcccccuuuucuaaggacaauagcauccgccuuuccgcgggaggcgauauuugggugacaagagagccuuauguuucuugugacccgagcaagugcuaccaauucgcucuggggcagggaaccacacucaacaaucggcauuccaacgauaccgugcacgaccgcacgcccuauagaacacugcugaugaaugaacucggcgucccuuuucaucuggggacccgccagguguguauggccuggucuagcuccagcugccacgauggaaaagccuggcuucauguuugugugacaggccacgacgagaacgcuaccgccucuuucaucuacgauggccggcuggucgacuccaucgggagcuggucuaagaauauucucagaacccaggaauccgagugcguguguaucaacggaacaugcacgguggucaugaccgauggcagcgcuuccgagcgggccgacacaaaaauucuguuuaucgaagaggggaagauuguucacaucucuccccuuagcggauccgcgcaacauguggaagagugcagcuguuauccucgcuaccccggcgugagaugcgucugucgggauaauuggaaagggucuaaccgcccgaucguggacauuaacguuaaggauuacuccaucgugagcucuuaugucugcagcggacuggugggcgacaccccuagaaagaaugaccgguccucuagcuccuacugucgcaaccccaauaacgaaaaaggcagccacgggguuaagggaugggccuucgaugacggcaaugauguguggauggggagaacaauuggagaggagcuccggucuggcuaugaaaccuuuaaagucaucgggggaugguccacgccuaacagcaagcugcagauuaauagacaggugaucgucgacucuggcaaccgcuccggcuacagcgggaucuucuccguggagggaaaaucuugcauuaaucgguguuuuuauguugaacugaucagaggccgcaagcaggagacacgggugugguggaccagcaacuccauugucguguucugcgggaccucuggaacauacggcaccgggagcuggcccgauggcgcugacaucaaucucaugcccauuuga

SEQ ID NO: 205040 - RNA, 1410 nt, Artificial Sequence
  derived and/or modified sequence opt5 from neuraminidase__InfluenzaA__AFG99361
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaaaauguccuaagcuggccgaguaccggaauuggagcaaaccccagugcaagauuaccggguucgcgccuuuuuccaaggacaacucuauccgccuuagcgcuggaggcgauauuugggucacaagagagcccuauguguccugugacccugggaaaugcuaccaauucgcccugggacagggcaccacacucaauaaccggcauucuaaugauaccguucacgaccgcacgccguauagaacacugcugaugaacgaacucggggugcccuuucaucugggaaccaagcaggucuguaucgccuggagcuccagcucuugccacgauggcaaggcuuggcuucauguguguguuacaggccacgacgagaaugccaccgcuuccuucaucuacgaugggcggcugguggacagcauuggaucuugguccaaaaacauccuccgcacccaggaaagcgagugcgucuguauuaauggcacaugcacgguggugaugaccgaugggucugccuccgagagagcggacacaaaaauccuguuuauugaagagggaaagaucguccacaucagcccucuuuccggcucugcccaacauguugaagagugcagcuguuauccccgguacccuggggugcgcugcguguguagagauaacuggaagggauccaaccggcccauugucgacaucaaugugaaagauuacagcauuguuucuuccuaugugugcagcggccuggucggcgacaccccgcgcaagaacgacucuagcuccucuagcuacuguagaaauccuaacaaugaaaaagggucccacggagugaagggcugggcuuucgaugacgggaacgauguuuggaugggacggacaaucagcgaggagcuccgcucuggcuaugaaaccuuuaaagugauugggggaugguccaagcccaauagcaaacugcagaucaacagacaggucaucguggaccggggcaauagaucuggcuacuccgggauuuucagcgucgagggaaaguccugcaucaaccgcuguuuuuauguggaacugauucggggcagaaagcaggagacggaaguuugguggacaucuaauagcaucguggucuucugcgggaccuccggaaccuacggcacagggucuuggccugauggcgccgacauuaaccucaugcccaucuga

SEQ ID NO: 205041 - RNA, 1410 nt, Artificial Sequence
  derived and/or modified sequence opt5 from neuraminidase__InfluenzaA__AFG99383
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacgagaacgcuaccgccagcuucauuuacgaugggcggcuugucgacucuaucggauccuggagcaaaaauauucugcgcacccaggaaucugagugcguguguaucaacggcacaugcacgguggucaugaccgauggguccgcuagcgagagagccgacacaaagauucucuuuaucgaagagggaaaaaucguucacauuagcccccugucuggcagcgcgcaacauguggaagagugcuccuguuauccucgguaccccggggugcgcugcgucuguagagauaauuggaagggaagcaaccggccgaucguggacauuaacguuaaggauuacucuaucguguccagcuaugucugcucuggccuugugggcgacaccccucgcaaaaaugacagcuccucuagcuccuacuguagaaaccccaauaacgaaaaggggagccacggaguuaaaggcugggccuucgaugacgggaaugauguguggaugggacggacaauuggcgaggagcugcgcucuggguaugaaaccuuuaaggucaucggaggcugguccacgccuaacagcaaacuccagaucaauagacaggugauugucgacucuggcaaccgguccggguacagcggaaucuucuccguggagggcaagucuugcauuaauagauguuuuuauguugaacugauccgcgggcggaaacaggagacaaaggugugguggaccagcaacuccauugucguguucugcggaaccucuggcacauacgggaccggcagcuggcccgauggagcugacaucaaucugaugcccauuuga

SEQ ID NO: 205042 - RNA, 1410 nt, Artificial Sequence; identical to SEQ ID NO: 205041
  derived and/or modified sequence opt5 from neuraminidase__InfluenzaA__AFG99394

SEQ ID NO: 205043 - RNA, 1410 nt, Artificial Sequence
  derived and/or modified sequence opt5 from neuraminidase__InfluenzaA__AFG99405
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucauuuacgaugggcggcuugucgacucuaucggauccuggagcaagaauauucugcgcacccaggagucugaaugcguguguaucaacggcacaugcacgguggucaugaccgauggguccgcuagcgagagagccgacacaaaaauucucuuuaucgaggaaggaaagaucguucacauuagcccccugucuggcagcgcgcaacauguggaggaaugcuccuguuauccucgguaccccggggugcgcugcgucuguagagauaauuggaagggaagcaaccggccgaucguggacauuaacguuaaagauuacucuaucauuuccagcuaugugugcucuggccuugucggcgacaccccucgcaagaaugacagaagcuccucuagcuacugucggaaccccaauaacgagaaagggucccacggagugaagggcugggccuucgaugacgggaaugauguuuggaugggacgcacaaucggcgaggaacugagaagcggguaugagaccuuuaaagugaucggaggcuggucuacgccuaacuccaagcuccagauuaaucggcaggucaucguggacagcggcaacagaucuggguacuccggaauuuucagcgucgaaggcaaauccugcaucaaucgcuguuuuuauguggagcugauucgggggagagaacaggagacacgcguuugguggaccucuaacagcaucguggucuucugcggaaccuccggcacauacgggaccggcucuuggcccgauggagcugacauuaaucugaugcccaucuga

SEQ ID NO: 205044 - RNA, 1410 nt, Artificial Sequence
  derived and/or modified sequence opt5 from neuraminidase__InfluenzaA__AFG99416
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacgagaacgcuaccgccagcuucauuuacgaugggcggcuugucgacucuaucggauccuggagcaaaaauauucugcgcacccaggaaucugagugcguguguaucaacggcacaugcacgguggucaugaccgauggguccgcuagcgagagagccgacacaaagauucucuuuaucgaagagggaaaaaucauucacaucagcccccugucuggcagcgcgcaacauguugaagagugcuccuguuauccucgguaccccggggugcgcugcguguguagagauaauuggaagggaagcaaccggccgauugucgacaucaacgugaaggauuacucuauuguuuccagcuaugugugcucuggccuugucggcgacaccccucgcaaaaaugacagcuccucuagcuccuacuguagaaaccccaauaacgaaaaggggagccacggagugaaaggcugggccuucgaugacgggaaugauguuuggaugggacggacaaucggcgaggagcugcgcucuggguaugaaaccuuuaaggugaucggaggcugguccacgccuaacagcaaacuccagauuaauagacaggucaucguggacggcgggaaccggucuggauacuccggcauuuucagcgucgaggggaaguccugcaucaauagauguuuuuauguggaacugauucgcggacggaaacaggagacaaagguuugguggaccucuaacagcaucguggucuucugcggcaccuccgggacauacggcaccggaucuuggcccgauggcgcugacauuaaucugaugcccaucuga

SEQ ID NO: 205045 - RNA, 1410 nt, Artificial Sequence
  derived and/or modified sequence opt5 from neuraminidase__InfluenzaA__AFG99427
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaagucugucccaaacucguggaguaccggaacugguccaagccucagugcaaaauuaccggguucgcccccuuuucuaaggacaauagcauccgccuguccgcgggaggcgauauuuggguuacaagagagccuuaugugucuugugacccggggaagugcuaccaauucgcucuuggacagggcaccacacugaacaaucggcauagcaacgauaccguccacgaccgcacgcccuauagaacacuccugaugaaugaacugggggugccuuuucaucucggaaccaaacagguuuguaucgccugguccuccucuuccugccacgauggcaaggccuggcugcaugugugugucacaggccacgacgagaacgcuaccgccagcuucaucuacgaugggcggcuuguggacucuauuggauccuggagcaaaaauauccugcgcacccaggaaucugagugcguguguauuaacggcacaugcacggucguuaugaccgauggguccgcuagcgagagagccgacacaaagauccucuuuauugaagagggaaaaaucauccacauuagcccccugucuggcagcgcgcaacauguggaagagugcuccuguuauccucgguaccccggggugcgcugcgucuguagagauaauuggaagggaagcaaccggccgaucguggacauuaacguuaaggauuacucuaucguguccagcuaugucugcucuggccuugugggcgacaccccucgcaaaaaugacagcuccucuagcuccuacuguagaaaccccaauaacgaaaaggggagccacggaguuaaaggcugggccuucgaugacgggaaugauguguggaugggacggacaauuggcgaggagcugcgcucuggguaugaaaccuuuaaggucaucggaggcugguccacgccuaacagcaaacuccagaucaauagacaggugauugucgacucuggcaaccgguccggguacagcggaaucuucuccguggagggcaagucuugcauuaauagauguuuuuauguugaacugauccgcgggcggaaacaggagacaaaggugugguggaccagcaacuccauugucguguucugcggaaccucuggcacauacgggaccggcagcuggcccgauggagcugacaucaaucugaugcccauuuga

SEQ ID NO: 205046 - RNA, 1410 nt, Artificial Sequence
  derived and/or modified sequence opt5 from neuraminidase__InfluenzaA__AFG99438
augaaccccaaucagaagaucauuaccaucggcagcgugucccugacaauugccacgaucugcuuccucaugcaaauugcuauccuggucaccacaguuacccuucacuuuagacaguacgaguguucuagcccuccgaacaaucaggugaugcccugcgaaccuacaaucauugagcggaacaucaccgaaauuguguaucugacaaauaccacgaucgagaaagaaauuugucccaagcucgucgaguaccgcaacugguccaaaccucagugcaagaucaccggguucgcccccuuuucuaaagacaauagcauuagacuguccgcgggaggcgauaucugggugacacgggagccuuauguuucuugugacccggggaagugcuaccaauucgcucuuggacagggcaccacacugaacaaucgccauagcaacgauaccgugcacgacagaacgcccuaucggacacuccugaugaaugaacugggggucccuuuucaucucggaaccaaacagguguguauggccugguccuccucuuccugccacgauggcaaggccuggcugcauguuugugugacaggccacgacgagaacgcuaccgccagcuucaucuacgaugggcgccuugucgacucuauuggauccuggagcaagaauauccugagaacccaggaaucugagugcguguguauuaacggcacaugcacgguggucaugaccgauggguccgcuagcgagcgggccgacacaaaaauccucuuuauugaagagggaaagaucguucacaucagcccccugucuggcagcgcgcaacauguggaagagugcuccuguuauccucgcuaccccggggugagaugcgucugucgggauaauuggaaaggaagcaaccgcccgauuguggacaucaacguuaaggauuacucuauuguguccagcuaugucugcucuggccuugugggcgacaccccuagaaagaaugaccggagcuccucuagcuacugucgcaaccccaauaacgaaaaagggucccacggaguuaagggcugggccuucgaugacgggaaugauguguggaugggaagaacaaucggcgaggagcugcggagcggguaugaaaccuuuaaagucauuggaggcuggucuacgccuaacuccaagcuccagaucaauagacaggugaucgucgacagcggcaaccgcucuggguacuccggaauuuucagcguggagggcaaauccugcaucaaucgguguuuuuauguugaacugauuagagggcgcaagcaggagacacgggugugguggaccucuaacagcaucgucguguucugcggaaccuccggcacauacgggaccggcucuuggcccgauggagcugacauuaaucugaugcccaucuga

SEQ ID NO: 205047 - RNA, 1410 nt, Artificial Sequence
  derived and/or modified sequence opt5 from neuraminidase__InfluenzaA__AFG99449
augaaccccaaucagaagaucauuaccaucggcagcgugucccugacaauugccacgaucugcuuccucaugcaaauugcuauccuggucaccacaguuacccuucacuuuagacaguacgaguguucuagcccuccgaacaaucaggugaugcccugcgaaccuacaaucauugagcggaacaucaccgaaauuguguaucugacaaauaccacgaucgagaaagaaauuugucccaagcucgucgaguaccgcaacugguccaaaccucagugcaagaucaccggguucgcccccuuuucuaaagacaauagcauuagacuguccgcgggaggcgauaucugggugacacgggagccuuauguuucuugugacccggggaagugcuaccaauucgcucuuggacagggcaccacacugaacaaucgccauagcaacgauaccgugcacgacagaacgcccuaucggacacuccugaugaaugaacugggggucccuuuucaucucggaaccaaacagguguguauggccugguccuccucuuccugccacgauggcaaggccuggcugcauguuugugugacaggccacgacgagaacgcuaccgccagcuucaucuacgaugggcgccuugucgacucuauuggauccuggagcaagaauauccugagaacccaggaaucugagugcguguguauuaacggcacaugcacgguggucaugaccgauggguccgcuagcgagcgggccgacacaaaaauccucuuuauugaagagggaaagaucguucacaucagcccccugucuggcagcgcgcaacauguggaagagugcuccuguuauccucgcuaccccggggugagaugcgucugucgggauaauuggaaaggaagcaaccgcccgauuguggacaucaacguuaaggauuacucuauuguguccagcuaugucugcucuggccuugugggcgacaccccuagaaagaaugaccggagcuccucuagcuacugucgcaaccccaauaacgaaaaagggucccacggaguuaagggcugggccuucgaugacgggaaugauguguggaugggaagaacaaucggcgaggagcugcggagcggguaugaaaccuuuaaagucauuggaggcuggucuacgccuaacuccaagcuccagaucaauagacaggugaucgucgacagcggcaaccgcucuggguacuccggaauuuucagcguggagggcaaaaauugcaucaaccgguguuuuuauguugaacugauuagagggcgcaagcaggagacacgggugugguggaccuccaauucuaucgucguguucugcggaaccagcggcacauacgggaccggcuccuggcccgauggagcugacauuaaccugaugcccaucuga

SEQ ID NO: 205048 - RNA, 1410 nt, Artificial Sequence
  derived and/or modified sequence opt5 from neuraminidase__InfluenzaA__AFG99471
augaaccccaaucagaagaucauuaccaucggcagcgugucccugauucucgccacaaucugcuuccugaugcaaauugcuauccuugucacgaccguuacacugcacuuuaaacaguacgaguguucuagcccuccgaacaaucaggugaugcccugcgaaccuaccaucauugagagaaacaucacagaaauuguguaucucaccaauacaaccaucgagaaggaaauuugucccaaacuggucgaguaccggaacugguccaagccucagugcaaaaucacgggguucgcccccuuuucuaaggacaauagcauucgccuuuccgcgggaggcgauaucugggugaccagagagccuuauguuucuugugacccggggaagugcuaccaauucgcucugggacagggcacaacccucaacaaucggcauagcaacgauacagugcacgaccgcaaucccuauagaacccugcugaugaacgaacucggggucccuuuucaucugggaacgcgccagguguguauggccugguccuccucuuccugccacgauggcaaagccuggcuucauguuugugugacaggccacgacgagaaugcuaccgccagcuucaucuacgaugggcggcuggucgacucuauuggauccuggagcaagaacauccucagaacacaggaaucugagugcguguguauuaaugggaccugcaccguggucaugacagauggcuccgcuagcgagcgggccgacacgaaaauccuguuuauugaagagggaaagaucguucacaucagcccccuuucuggcagcgcgcaacauguggaagagugcuccuguuauccucgcuaccccggggugagaugcgucugucgggauaacuggaaaggaagcaaccgcccgauuguggacaucaauguuaaggauuacucuauuguguccagcuaugucugcucuggccuggugggcgacaccccuagaaagaacgaccggagcuccucuagcuacugucgcaaucccaacaaugaaaaagggucccacggaguuaagggcugggccuucgaugacgggaacgauguguggaugggaagaacaaucggcgaggagcuccggagcggguaugaaaccuuuaaagucauuggaggcuggucuacaccuaauuccaagcugcagaucaacagacaggugaucgucgacagcggcaaucgcucuggguacuccggaauuuucagcguggagggcaaauccugcaucaaccgguguuuuuauguugaacugauuagagggcgcaagcaggagacccgggugugguggacgucuaauagcaucgucguguucugcggaacauccggcaccuacgggaccggcucuuggcccgauggagcugacauuaaccucaugcccaucuga

SEQ ID NO: 205049 - RNA, 1410 nt, Artificial Sequence
  derived and/or modified sequence opt5 from neuraminidase__InfluenzaA__AFG99482
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcccugcgaaccuacaaucauugagagaaauaucaccgaaauuguguaucugacaaacaccacgaucgagaaggaaauuugucccaaacucgucgaguaccggaauuggagcaagccucagugcaaaaucaccggguucgcccccuuuuccaaggacaacucuauucgccugagcgcgggaggcgauaucugggugacaagagagccuuauguuuccugugacccggggaagugcuaccaauucgcucuuggacagggcaccacacugaauaaccggcauucuaaugauaccgugcacgaccgcacgcccuauagaacacuccugaugaacgaacugggggucccuuuucaucucggaaccaaacagguguguaucgccuggagcuccagcucuugccacgauggcaaggccuggcugcauguuugugugacaggccacgacgagaaugcuaccgccuccuucauuuacgaugggcggcuugucgacagcaucggaucuugguccaaaaacauucugcgcacccaggaaagcgagugcguguguaucaauggcacaugcacgguggucaugaccgaugggucugcuuccggcagagccgacacaaagauucucuuuaucgaggaaggaaaaaucguucacauuagcccccuguccgggucugcgcaacauguggaggaaugcagcuguuauccucgguaccccggagugcgcugcgucuguagagauaacuggaagggcuccaaccggccgaucguggacauuaauguuaaggauuacagcaucgugucuuccuaugucugcagcggccuugugggggacaccccucgcaaaaacgacucuagcuccucuagcuacuguagaaaucccaacaaugagaagggaucccacggcguuaaagggugggccuucgaugacggaaacgauguguggaugggccggacaauuggggaggaacugcgcagcggauaugagaccuuuaaggucaucggcggcuggucuacgccuaauuccaaacuccagaucaacagacaggugauugucgaccgggggaauagaagcggauacucuggcaucuucuccguggaagggaagaacugcauuaaucgcuguuuuuauguugagcugauccggggaagaaaacaggaaacaaaggugugguggaccagcaacuccauugucguguucugcggcaccucugggacauacggcaccggaagcuggcccgauggcgcugacaucaaucugauguccauuuga

SEQ ID NO: 205050 - RNA, 1410 nt, Artificial Sequence
  derived and/or modified sequence opt5 from neuraminidase__InfluenzaA__AFG99493
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcccugcgaaccuacaaucauugagagaaauaucaccgaaauuguguaucugacaaacaccacgaucgagaaggaaauuugucccaaacucgucgaguaccggaauuggagcaagccucagugcaaaaucaccggguucgcccccuuuuccaaggacaacucuauucgccugagcgcgggaggcgauaucugggugacaagagagccuuauguuuccugugacccggggaagugcuaccaauucgcucuuggacagggcaccacacugaauaaccggcauucuaaugauaccgugcacgaccgcacgcccuauagaacacuccugaugaacgaacugggggucccuuuucaucucggaaccaaacagguguguaucgccuggagcuccagcucuugccacgauggcaaggccuggcugcauguuugugugacaggccacgacgagaaugcuaccgccuccuucauuuacgaugggcggcuugucgacagcaucggaucuugguccaaaaacauucugcgcacccaggaaagcgagugcguguguaucaauggcacaugcacgguggucaugaccgaugggucugcuuccgggagagccgacacaaagauucucuuuaucgaggaaggcaaaaucguucacauuagcccccuguccgggucugcgcaacauguggaggaaugcagcuguuauccucgguaccccggagugcgcugcgucuguagagauaacuggaagggcuccaaccggccgaucguggacauuaauguuaaggauuacagcaucgugucuuccuaugucugcagcggccuugugggggacaccccucgcaaaaacgacucuagcuccucuagcuacuguagaaaucccaacaaugagaagggaucccacggcguuaaagggugggccuucgaugacggaaacgauguguggaugggccggacaauuggggaggaacugcgcagcggauaugagaccuuuaaggucaucggcggcuggucuacgccuaauuccaaacuccagaucaacagacaggugauugucgaccgggggaauagaagcggauacucuggcaucuucuccguggaaggaaagagcugcauuaaccgcuguuuuuauguugagcugauccggggaagaaaacaggaaacaaaggugugguggaccuccaauucuauugucguguucugcggcaccagcgggacauacggcaccggauccuggcccgauggcgcugacaucaaccugaugcccauuuga

SEQ ID NO: 205051 - RNA, 1410 nt, Artificial Sequence
  derived and/or modified sequence opt5 from neuraminidase__InfluenzaA__AFG99504
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacgagaacgcuaccgccagcuucauuuacgaugggcggcuugucgacucuaucggauccuggagcaaaaauauucugcgcacccaggaaucugagugcguguguaucaacggcacaugcacgguggucaugaccgauggguccgcuagcgagagagccgacacaaagauucucuuuaucgaagagggaaaaaucguucacauuagcccccugucuggcagcgcgcaacauguggaagagugcuccuguuauccucgguaccccggggugcgcugcgucuguagagauaauuggaagggaagcaaccggccgaucguggacauuaacguuaaggauuacucuaucguguccagcuaugucugcucuggccuugugggcgacaccccucgcaaaaaugacagaagcuccucuagcuacugucggaaccccaauaacgaaaaggggucccacggaguuaaaggcugggccuucgaugacgggaaugauguguggaugggacgcacaauuggcgaggagcugagaagcggguaugaaaccuuuaaggucaucggaggcuggucuacgccuaacuccaaacuccagaucaauagacaggugauugucgacagcggcaaccggucuggguacuccggaaucuucagcguggagggcaaguccugcauuaaucgcuguuuuuauguugaacugauccgggggagaaaacaggagacacgcgugugguggaccucuaacagcauugucguguucugcggaaccuccggcacauacgggaccggcucuuggcccgauggagcugacaucaaucugaugcccauuuga

SEQ ID NO: 205052 - RNA, 1410 nt, Artificial Sequence
  derived and/or modified sequence opt5 from neuraminidase__InfluenzaA__AFG99515
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguagaaauccuaacaaugaaaaggggucccacggagugaaaggcugggcuuucgaugacgggaacgauguuuggaugggacggacaauuggcgaggagcuccgcagcggguaugaaaccuuuaaggugaucggaggcuggucuacgcccaauuccaaacugcagaucaacagacaggucauuguggaccggggcaauagaagcggguacucuggaaucuucuccgucgagggcaagagcugcauuaaccgcuguuuuuauguggaacugauccgggggagaaaacaggagacagaaguuugguggaccuccaauucuauuguggucuucugcggaaccagcggcacauacgggaccggcuccuggccugauggagccgacaucaaccucaugcccauuuga

SEQ ID NO: 205053 - RNA, 1410 nt, Artificial Sequence
  derived and/or modified sequence opt5 from neuraminidase__InfluenzaA__AFG99526
augaaccccaaucagaagaucauuaccaucggcagcgugucccugacacucgccacgauuugcuuccugaugcaaaucgcuauucuugucaccacaguuacccugcacuuuaaacaguacgaguguucuagcccuccgaacaaucaggugaugcccugcgaaccuacaaucaucgagagaaacauuaccgaaaucguguaucucacaaauaccacgauugagaaggaagucugucccaaacugguggaguaccggaacugguccaagccucagugcaaaaucaccggguucgcccccuuuucuaaggacaauagcauucgccuuuccgcgggaggcgauaucuggguuacaagagagccuuaugugucuugugacccggggaagugcuaccaauucgcucugggacagggcaccacacucaacaaucggcauagcaacgauaccguccacgaccgcacgcccuauagaacacugcugaugaaugaacucggggugccuuuucaucugggaacccggcagguuuguauggccugguccuccucuuccugccacgauggcaaagccuggcuucaugugugugucacaggccacgacgagaacgcuaccgccagcuucauuuacgaugggcgccugguggacucuaucggauccuggagcaagaauauccucagaacccaggaaucugagugcguguguauuaacggcacaugcacggucguuaugaccgauggguccgcuagcggacgggccgacacaaaaauccuguuuauugaggaaggcaagaucgugcacauuagcccccuuucugggagcgcgcaacauguggaggaaugcuccuguuauccucgcuaccccggagucagaugcgugugucgggauaauuggaaaggcagcaaccgcccgaucguugacaucaacgugaaggauuacucuauugucuccagcuaugugugcucuggccugguuggggacaccccuagaaagaaugaccggagcuccucuagcuacugucgcaaccccaauaacgagaaaggaucccacggcgugaaggggugggccuucgaugacggaaaugaugucuggaugggcagaacaaucggggaggaacuccggagcggauaugagaccuuuaaagugauuggcggcuggucuacgccuaacuccaagcugcagaucaauagacaggucauuguggacagcgggaaccgcucuggauacuccggcaucuucagcguugaagggaaauccugcaucaaucgguguuuuuauguggagcugauuagaggacgcaagcaggaaacacgggucugguggaccucuaacagcaucgugguuuucugcggcaccuccgggacauacggcaccggaucuuggcccgauggcgcugacauuaaucucaugcccaucuga

SEQ ID NO: 205054 - RNA, 1410 nt, Artificial Sequence; identical to SEQ ID NO: 204950
  derived and/or modified sequence opt5 from neuraminidase__InfluenzaA__AFG99537

SEQ ID NO: 205055 - RNA, 1410 nt, Artificial Sequence; identical to SEQ ID NO: 204950
  derived and/or modified sequence opt5 from neuraminidase__InfluenzaA__AFG99548

SEQ ID NO: 205056 - RNA, 1410 nt, Artificial Sequence; identical to SEQ ID NO: 204950
  derived and/or modified sequence opt5 from neuraminidase__InfluenzaA__AFG99559

SEQ ID NO: 205057 - RNA, 1410 nt, Artificial Sequence; identical to SEQ ID NO: 204950
  derived and/or modified sequence opt5 from neuraminidase__InfluenzaA__AFG99570

SEQ ID NO: 205058 - RNA, 1410 nt, Artificial Sequence; identical to SEQ ID NO: 204950
  derived and/or modified sequence opt5 from neuraminidase__InfluenzaA__AFG99581

SEQ ID NO: 205059 - RNA, 1410 nt, Artificial Sequence
  derived and/or modified sequence opt5 from neuraminidase__InfluenzaA__AFG99592
augaaccccaaucagaagaucauuaccaucggcagcgugucccugacaauugccacgaccugcuuccucaugcaaaucgcuauucuggucacaaccguuacacuucacuuuaaacaguacgaguguaacucuccuccgaauaaccaggugaugcccugcgaaccuaccaucaucgagagaaauauuacagaaaucguguaucugaccaacacgaccauugagaaggaaaucugucccaaacucgucgaguaccggaauuggagcaagccucagugcaaaauuacaggguucgcccccuuuuccaaggacaacucuauccgccugagcgcgggaggcgauauuugggugaccagagagccuuauguuuccugugacccggggaagugcuaccaauucgcucuuggacagggcacaacccugaauaaccggcauucuaaugauacggugcacgaccgcacacccuauagaacccuccugaugaacgaacugggggucccuuuucaucucggaacaaaacagguguguaucgccuggagcuccagcucuugccacgauggcaaggccuggcugcauguuugugugaccggccacgacgagaaugcuaccgccuccuucaucuacgaugggcggcuugucgacagcauugugucuugguccaaaaacauccugcgcacacaggaaagcgagugcguguguauuaauggaacgugcaccgucguuaugacagauggcucugcuuccgagagagccgacaccaagauccucuuuauugaagaggggaaaaucgugcacaucagcccccuguccggaucugcgcaacauguggaagagugcagcuguuauccucgguaccccggcguccgcugcguguguagagauaacuggaagggguccaaccggccgauuguugacaucaaugugaaggauuacagcauugucucuuccuaugugugcagcggacuuguuggcgacacaccucgcaaaaacgacucuagcuccucuagcuacuguagaaaucccaacaaugaaaagggcucccacggggugaaaggaugggccuucgaugacggcaacgaugucuggauggggcggaccaucggagaggagcugcgcagcggcuaugaaacguuuaaggugauugggggauggucuacaccuaauuccaaacuccagaccaacagacaggucaucguggaccggggcaauagaagcggcuacucugggaucuucuccguugagggaaagagcugcauuaaccgcuguuuuuauguggaacugauccggggcagaaaacaggagaccaaggucugguggacauccaauucuauugugguuuucugcgggaccagcggaacauacggcacgggguccuggcccgauggcgcugacaucaaccugaugcccauuuga

SEQ ID NO: 205060 - RNA, 1410 nt, Artificial Sequence; identical to SEQ ID NO: 204950
  derived and/or modified sequence opt5 from neuraminidase__InfluenzaA__AFG99603

SEQ ID NO: 205061 - RNA, 1410 nt, Artificial Sequence; identical to SEQ ID NO: 204950
  derived and/or modified sequence opt5 from neuraminidase__InfluenzaA__AFG99614

SEQ ID NO: 205062 - RNA, 1410 nt, Artificial Sequence; identical to SEQ ID NO: 204950
  derived and/or modified sequence opt5 from neuraminidase__InfluenzaA__AFG99625

SEQ ID NO: 205063 - RNA, 1410 nt, Artificial Sequence
  derived and/or modified sequence opt5 from neuraminidase__InfluenzaA__AFG99636
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucgucucuugguccaaaaacauucuccgcacccaggaaagcgagugcguguguaucaauggaacaugcacgguggucaugaccgauggcucugccuccgagagagcggacacaaagauucuguuuaucgaagaggggaaaaucguucacauuagcccucuuuccggaucugcccaacauguggaagagugcagcuguuauccccgguacccuggcgugcgcugcgucuguagagauaacuggaagggguccaaccggcccaucguggacauuaauguuaaggauuacagcaucgugucuuccuaugucugcagcggacuggugggcgacaccccgcgcaaaaacgacucuagcuccucuagcuacuguagaaauccuaacaaugaaaagggcucccacgggguuaaaggaugggcuuucgaugacggcaacgauguguggauggggcggacaauuggagaggaccuccgcagcggcuaugagaccuuuaaggucaucgggggauggucuacgcccaauuccaaacugcagacaaacagacaggugaucgucgaucggggcaauagaagcggcuacucugggauuuucuccguggaaggaaagagcugcaucaaccgcuguuuuuauguugagcugauucggggcagaaaacaggaaaccaaggugugguggaccuccaauucuaucgucguguucugcgggacaagcggaaccuacggcacaggguccuggccugacggcgccgauauuaaccucaugcccaucuga

SEQ ID NO: 205064 - RNA, 1410 nt, Artificial Sequence
  derived and/or modified sequence opt5 from neuraminidase__InfluenzaA__AFG99658
augaaccccaaucagaagaucauuaccaucggcagcgugucccugacaauugccacgaucugcuuccucaugcaaauuaccauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggucgaguaccggaauuggagcaagccccagugcaaaaucacaggguucgcuccuuuuuccaaggacaacucuauucgccuuagcgccggaggcgauaucugggugaccagagagcccuauguuuccugugacccugggaagugcuaccaauucgcgcugggacagggcacaacccucaauaaccggcauucuaaugauacggugcacgaccgcacaccguauagaacccugcugaugaacgaacucgggguccccuuucaucugggaacaaaacagguguguaucgcuuggagcuccagcucuugccacgauggcaaggccuggcuucauguuugugugaccggccacgacgagaaugccaccgcuuccuucauuuacgaugggcggcuggucgacagcaucucuuccuggagcaaaaacauucuccgcacacaggaaucugagugcguguguaucaauggaacgugcaccguggucaugacagauggcuccgccagcgagagagcugacaccaagauucuguuuaucgaagaggggaaaaucguucacauuuccccucuuucuggaagcgcccaacauguggaagagugcuccuguuauccccgguacccuggcgugcgcugcgucuguagagauaacuggaaggggagcaaccggcccaucguggacauuaauguuaaggauuacucuaucguguccagcuaugucugcucuggacuggugggcgacacaccgcgcaaaaacgacagcuccucuagcuccuacuguagaaauccuaacaaugaaaagggcagccacgggguuaaaggaugggcguucgaugacggcaacgauguguggauggggcggaccauuucugaggagcuccgcuccggauaugaaacguuuaaggucaucggcggguggagcacacccaauucuaaacugcagaucaacagacaggugauugucgaccggggaaauagauccggcuacagcggcaucuucuccguggaggggaagucuugcauuaaccgcuguuuuuauguugaacugauccggggaagaaaacaggagaauaaggugugguggaccagcaacuccauugucguguucugcggcaccucugggacauacggaaccggcagcuggccugauggggccgacaucaaucucaugcccauuuga

SEQ ID NO: 205065 - RNA, 1410 nt, Artificial Sequence
  derived and/or modified sequence opt5 from neuraminidase__InfluenzaA__AFG99680
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugauccugugccagcccacaauuaucgaaagaaacauuaccgagaucguguaucucacaaauaccacgauugaaaaggagaucuguccuaaacuggucgaauaccggaacugguccaagccccaaugcaaaauuaccggguucgccccuuuuucuaaggacaauagcauccgccuuuccgcgggaggcgauaucugggugacaagagagcccuauguuucuugugacccuagcaagugcuaccaguucgcucuggggcagggaaccacacucaacaaucggcauuccaacgauaccgugcacgaccgcacgccguauagaacacugcugaugaaugagcucggcguccccuuucaucuggggaccaaacagguguguauugccuggucuagcuccagcugccacgauggaaaggccuggcuucauguuugugugacaggccacgacgaaaacgcuaccgccucuuucaucuacgauggccggcuggucgacuccauugggagcuggucuaaaaauauccuccgcacccaagaguccgaaugcguguguauuaacggaacaugcacgguggucaugaccgauggcagcgcuuccgagagagccgacacaaagauccuguuuaucgaggaagggaaaguugugcacauuucuccucuuagcggauccgcgcagcauguggaggaaugcagcuguuauccccgguacccuggcguccgcugcguguguagagauaauuggaaggggucuaaccggcccaucguugacauuaacgugaaggauuacuccaucgucagcucuuaugugugcagcggacugguuggcgacaccccgcgcaaaaaugacuccucuagcuccagcuacuguagaaacccuaauaacgagaagggcucucacggggugaaaggaugggccuucgaugacggcaaugaugucuggauggggcggacaauuuccgaggaacuccgcagcggauaugagaccuuuaaggugaucggcggguggucuacgcccaacuccaaacugcagaucaauagacaggucauuguggacagcggaaaccgguccggcuacucuggcaucuucagcguugaagggaaguccugcauuaauagauguuuuuauguggagcugauccgcggacggaaacaagaaacaaaggucugguggaccucuaacagcauugugguuuucugcggcaccuccgggacauacggaaccggcagcuggccugauggggcugacaucaaucucaugcccauuuga

SEQ ID NO: 205066 - RNA, 1410 nt, Artificial Sequence
  derived and/or modified sequence opt5 from neuraminidase__InfluenzaA__AFG99691
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcccugcgaaccuacaaucauugagagaaauaccacagaaaucguguaucugaccaacacgaccauugagaaggaaaucugucccaaacucgucgaguaccggaauuggagcaagccucagugcaaaauuacaggguucgcccccuuuuccaaggacaacucuauccgccugagcgcgggaggcgauauuugggugaccagagagccuuauguuuccugugacccggggaagugcuaccaauucgcucuuggacagggcacaacccugaauaaccggcauucuaaugauacggugcacgaccgcacacccuauagaacccuccugaugaacgaacugggggucccuuuucaucucggaacaaaacagguguguaucgccuggagcuccagcucuugccacgauggcaaggccuggcugcauguuugugugaccggccacgacgagaaugcuaccgccuccuucaucuacgaugggcggcuugucgacagcauugugucuugguccaaaaacauccugcgcacacaggaaagcgagugcguguguauuaauggaacgugcaccgucguuaugacagauggcucugcuuccgagagagccgacaccaagauccucuuuauugaagaggggaaaaucgugcacaucagcccccuguccggaucugcgcaacauguggaagagugcagcuguuauccucgguaccccggcguccgcugcguguguagagauaacuggaagggguccaaccggccgauuguugacaucaaugugaaggauuacagcauugucucuuccuaugugugcagcggacuuguuggcgacacaccucgcaaaaacgacucuagcuccucuagcuacuguagaaaucccaacaaugaaaagggcucccacggggugaaaggaugggccuucgaugacggcaacgaugucuggauggggcggaccaucggagaggagcugcgcagcggcuaugaaacguuuaaggugauugggggauggucuacaccuaauuccaaacuccagaccaacagacaggucaucguggaccggggcaauagaagcggcuacucugggaucuucuccguugagggaaagagcugcauuaaccgcuguuuuuauguggaacugauccggggcagaaaacaggagaccaaggucugguggacauccaauucuauugugguuuucugcgggaccagcggaacauacggcacgggguccuggcccgauggcgcugacaucaaccugaugcccauuuga

SEQ ID NO: 205067 - RNA, 1410 nt, Artificial Sequence; identical to SEQ ID NO: 204950
  derived and/or modified sequence opt5 from neuraminidase__InfluenzaA__AFG99704

SEQ ID NO: 205068 - RNA, 1410 nt, Artificial Sequence; identical to SEQ ID NO: 204950
  derived and/or modified sequence opt5 from neuraminidase__InfluenzaA__AFG99715

SEQ ID NO: 205069 - RNA, 1410 nt, Artificial Sequence; identical to SEQ ID NO: 204950
  derived and/or modified sequence opt5 from neuraminidase__InfluenzaA__AFG99726

SEQ ID NO: 205070 - RNA, 1410 nt, Artificial Sequence
  derived and/or modified sequence opt5 from neuraminidase__InfluenzaA__AFG99737
augaaccccaaucagaagaucauuaccaucggcagcgugucccugacaauugccacgaucugcuuccucaugcaaauuaccauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggucgaguaccggaauuggagcaagccccagugcaaaaucacaggguucgcuccuuuuuccaaggacaacucuauucgccuuagcgccggaggcgauaucugggugaccagagagcccuauguuuccugugacccugggaagugcuaccaauucgcgcugggacagggcacaacccucaauaaccggcauucuaaugauacggugcacgaccgcacaccguauagaacccugcugaugaacgaacucgggguccccuuucaucugggaacaaaacagguguguaucgcuuggagcuccagcucuugccacgauggcaaggccuggcuucauguuugugugaccggccacgacgagaaugccaccgcuuccuucauuuacgaugggcggcuggucgacagcaucggaucuugguccaaaaacauucuccgcacacaggaaagcgagugcguguguaucaauggcacgugcaccguggucaugacagaugggucugccuccgagagagcugacaccaagauucuguuuaucgaagagggaaaaaucguucacauuagcccucuuuccggcucugcccaacauguggaagagugcagcuguuauccccgguacccuggggugcgcugcgucuguagagauaacuggaagggauccaaccggcccaucguggacauuaauguuaaggauuacagcaucgugucuuccuaugucugcagcggccuggugggcgacacaccgcgcaaaaacgacucuagcuccucuagcuacuguagaaauccuaacaaugaaaaggggucccacggaguuaaaggcugggcguucgaugacgggaacgauguguggaugggacggaccauuagcgaggagcuccgcucuggcuaugaaacguuuaaggucaucgggggaugguccacacccaauagcaaacugcagaucaacagacaggugauugucgaccggggcaauagaucuggcuacuccgggaucuucagcguggagggaaaguccugcauuaaccgcuguuuuuauguugaacugauccggggcagaaaacaggagaauaaggugugguggaccucuaacagcauugucguguucugcgggaccuccggaacauacggcaccgggucuuggccugauggcgccgacaucaaucucaugcccauuuga

SEQ ID NO: 205071 - RNA, 1410 nt, Artificial Sequence
  derived and/or modified sequence opt5 from neuraminidase__InfluenzaA__AFG99748
augaaccccaaucagaagaucauuaccaucggcagcgugucccugacaauugccacgaucugcuuccucaugcaaauugcuauccuggucaccacaguuacccuucacuuuaaacaguacgacuguaacucuccuccgaauaaccaggccaugcugugcgagcccacaaucauugaaagaaauaucaccgagauuguguaucucacaaacaccacgaucgaaaaggagauuuguccuaaacuggcggaauaccggaauuggagcaagccccagugcaaaaucaccggguucgcuccuuuuuccaaggauaacucuauucgccuuagcgccggaggcgacaucugggugacaagagagcccuaugucuccugugauccugggaagugcuaccaauucgcccugggacagggcaccacacucaauaaccggcauucuaaugacaccgugcacgaucgcacgccguauagaacacugcugaugaacgagcucgggguucccuuucaucugggaaccaaacagguguguaucgcuuggagcuccagcucuugccacgacggcaaggccuggcuucaugucugugugacaggccacgaugaaaaugcuaccgccuccuucauuuacgacgggcggcugguugauagcaucggaucuugguccaaaaacauucuccgcacccaggagagcgaaugcguguguaucaauggcacaugcacggucgugaugaccgacgggucugcguccgagagagccgauacaaagauucuguuuaucgaggaaggaaaaaucgugcacauuagcccucuuuccggcucugcucaacaugucgaggaaugcagcuguuauccccgguacccugggguucgcugcguguguagagacaacuggaagggauccaaccggcccaucguggauauuaaugucaaggacuacagcaucgugucuuccuauguuugcagcggccuggugggcgacaccccgcgcaaaaacgauucuagcuccucuagcuacuguagaaauccuaacaaugagaaggggucccacggagucaaaggcugggccuucgacgaugggaacgacguguggaugggacggacaauuggcgaggaacuccgcagcggguaugagaccuuuaagguuaucggaggcuggucuacgcccaauuccaaacugcagaucaacagacaggugauugucgaucggggcaauagaagcggguacucuggaaucuucuccguggaaggcaagagcugcacaaaccgcuguuuuuaugucgagcugauucgggggagaaaacaggaaaccgaggugugguggaccuccaauucuaucguuguguucugcggaacaagcggcaccuacgggacaggcuccuggccugacggagcugauauuaaccucaugcccaucuga

SEQ ID NO: 205072 - RNA, 1410 nt, Artificial Sequence; identical to SEQ ID NO: 204950
  derived and/or modified sequence opt5 from neuraminidase__InfluenzaA__AFG99759

SEQ ID NO: 205073 - RNA, 1410 nt, Artificial Sequence
  derived and/or modified sequence opt5 from neuraminidase__InfluenzaA__AFG99770
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccagaucaugcugugcgaacccacaauuaucgagagaaauauuaccgaaaucguguaucucacaaacaccacgauugagcgggaaaucuguccuaagcugguggaguaccgcaauuggagcaaaccccagugcaagauuaccggguucgccccuuuuuccaaagacaacucuaucagacuuagcgcgggaggcgauaucugggucacacgggagcccuauguguccugugacccugggaagugcuaccaauucgcucugggacagggcaccacacucaauaaccgccauucuaaugauaccguucacgacagaacgccguaucggacacugcugaugaacgaacucggggugcccuuucaucugggaaccaagcaggucuguauugccuggagcuccagcucuugccacgauggcaaagccuggcuucauguguguguuacaggccacgacgagaaugcuaccgccuccuucaucuacgaugggcgccugguggacagcauuggaucuugguccaagaacauccucagaacccaggaaagcgagugcgucuguauuaauggcacaugcacgguggugaugaccgaugggucugcuuccgagcgggccgacacaaaaauccuguuuaucgaagagggaaagauuguccacaucagcccucuuuccggcucugcgcaacauguugaagagugcagcuguuauccccgcuacccuggggugagaugcgugugucgggauaacuggaaaggauccaaccgccccauugucgacaucaaugugaaggauuacagcauuguuucuuccuaugugugcagcggccuggucggcgacaccccgagaaagaacgacucuagcuccucuagcuacugucggaauccuaacaaugaaaaagggucccacggagugaagggcugggccuucgaugacgggaacgauguuuggaugggacgcacaaucggcgaggagcucagaagcggguaugaaaccuuuaaagugaucggaggcuggucuacgcccaauuccaagcugcagauuaaccggcaggucaucguggacagaggcaaucgcagcggguacucuggaauuuucuccgucgagggcaaaagcugcaucaaccgguguuuuuauguggaacugauuagagggcgcaagcaggagacagaaguuugguggaccuccaauucuaucguggucuucugcggaaccagcggcacauacgggaccggcuccuggccugauggagcugacauuaaccucaugcccaucuga

SEQ ID NO: 205074 - RNA, 1410 nt, Artificial Sequence
  derived and/or modified sequence opt5 from neuraminidase__InfluenzaA__AFG99781
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugccagcccacaaucauugaaagaaacaucaccgagauuguguaucucacaaauaccacgaucgaaaaggagauuuguccuaaacuggucgaauaccggaacugguccaagccccaaugcaaaaucaccggguucgccccuuuuucuaaggacaauagcauucgccuuuccgcgggaggcgauaucugggugacaagagagcccuauguuucuugugacccugggaagugcuaccaguucgcucugggacagggcaccacacucaacaaucggcauagcaacgauaccgugcacgaccgcacgccguauagaacacugcugaugaaugagcucgggguccccuuucaucugggaaccaaacagguguguaucgccugguccucuagcuccugccacgauggcaaggccuggcuucauguuugugugacaggccacgacgaaaacgcuaccgccagcuucauuuacgaugggcggcuggucgacucuaucggauccuggagcaaaaauauucuccgcacccaagagucugaaugcguguguaucaacggcacaugcacgguggucaugaccgauggguccgcuagcaagagagccgacacaaaaauucuguuuaucgaggagggaaagaucguucacauuuccccucuuucuggcagcgcgcagcauguggaagagugcuccuguuauccccgguacccuggggugcgcugcgucuguagagauaauuggaagggaagcaaccggcccaucguggacauuaacguuaaagauuacucuaucguguccagcuaugucugcucuggccuggugggcgacaccccgcgcaagaaugacagcuccucuagcuccuacuguagaaacccuaauaacgaaaaagggagccacggaguuaagggcugggccuucgaugacgggaaugauguguggaugggacggacaauuucugaggaacuccgcuccggcuaugagaccuuuaaagucaucgggggauggagcacgcccaacucuaagcugcagacaaauagacaggugaucgucgacuccggcaaccggagcggcuacuccgggauuuucucuguggagggaaaaagcugcaucaauagauguuuuuauguugaacugauucgcggccggaagcaagagaccaaggugugguggaccuccaacucuaucgucguguucugcgggacaagcggaaccuacggcacaggguccuggccugauggcgcugacauuaaucucaugcccaucuga

SEQ ID NO: 205075 - RNA, 1410 nt, Artificial Sequence; identical to SEQ ID NO: 204950
  derived and/or modified sequence opt5 from neuraminidase__InfluenzaA__AFG99792

SEQ ID NO: 205076 - RNA, 1410 nt, Artificial Sequence; identical to SEQ ID NO: 205070
  derived and/or modified sequence opt5 from neuraminidase__InfluenzaA__AFG99803

SEQ ID NO: 205077 - RNA, 1410 nt, Artificial Sequence; identical to SEQ ID NO: 204950
  derived and/or modified sequence opt5 from neuraminidase__InfluenzaA__AFG99825

SEQ ID NO: 205078 - RNA, 1410 nt, Artificial Sequence; identical to SEQ ID NO: 204950
  derived and/or modified sequence opt5 from neuraminidase__InfluenzaA__AFG99836

SEQ ID NO: 205079 - RNA, 1410 nt, Artificial Sequence; identical to SEQ ID NO: 204950
  derived and/or modified sequence opt5 from neuraminidase__InfluenzaA__AFG99847

SEQ ID NO: 205080 - RNA, 1410 nt, Artificial Sequence; identical to SEQ ID NO: 204950
  derived and/or modified sequence opt5 from neuraminidase__InfluenzaA__AFG99858

SEQ ID NO: 205081 - RNA, 1410 nt, Artificial Sequence; identical to SEQ ID NO: 204950
  derived and/or modified sequence opt5 from neuraminidase__InfluenzaA__AFG99869

SEQ ID NO: 205082 - RNA, 1410 nt, Artificial Sequence; identical to SEQ ID NO: 204950
  derived and/or modified sequence opt5 from neuraminidase__InfluenzaA__AFG99880

SEQ ID NO: 205083 - RNA, 1410 nt, Artificial Sequence
  derived and/or modified sequence opt5 from neuraminidase__InfluenzaA__AFG99891
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguauuucacaaacaccacgaucgagaaggaaauuuguccuaaacucgccgaguaccggaauuggagcaagccccagugcaaaaucaccggguuugcgccuuucuccaaggacaacucuauucgccugagcgcuggaggcgauaucugggucacaagagagcccuauguguccugugacccugggaagugcuaccaauuugcccuuggacagggcaccacacugaauaaccggcauucuaaugauaccguucacgaccgcacgccguauagaacacuccugaugaacgaacugggggugcccuuccaucucggaaccaaacaggucuguaucgccuggagcuccagcucuugccacgauggcaaggcuuggcugcauguguguguuacaggccacgacgagaaugccaccgcuuccuuuauuuacgaugggcggcuuguggacagcaucggaucuugguccaaaaacauucugcgcacccaggaaagcgagugcgucuguaucaauggcacaugcacgguggugaugaccgaugggucugccuccgagagagcggacacaaagauucucuucaucgaagagggaaaaaucguccacauuagcucccugucuggcagcgcccaacauguugaagagugcuccuguuauccucgguaccccggggugcgcugcguguguagagauaacuggaagggaagcaaccggccuaucgucgacauuaaugugaaggauuacucuaucguuuccagcuaugugugcucuggccuugucggcgacacaccccgcaaaaacgacagcuccucuagcuccuacuguagaaauccgaacaaugaaaaggggagccacggagugaaaggcugggcuuuugaugacgggaacgauguuuggaugggacggaccauuggcgaggagcugcgcucuggguaugaaaccuucagagugaucggaggcugguccacgccuaauagcaagcuccagaucaaccggcaggucauuguggacagaggcaaucgcucuggguacuccggaaucuuuagcgucgagggcaaauccugcauuaaccgguguuucuauguggaacugaucagagggcgcaagcaggagacagaaguuugguggaccucuaauagcauuguggucuuuugcggaaccuccggcacauacgggaccggcucuuggcccgauggagccgacaucaaccugaugccuauuuga

SEQ ID NO: 205084 - RNA, 1410 nt, Artificial Sequence; identical to SEQ ID NO: 204950
  derived and/or modified sequence opt5 from neuraminidase__InfluenzaA__AFG99902

SEQ ID NO: 205085 - RNA, 1410 nt, Artificial Sequence; identical to SEQ ID NO: 204950
  derived and/or modified sequence opt5 from neuraminidase__InfluenzaA__AFG99913

SEQ ID NO: 205086 - RNA, 1410 nt, Artificial Sequence; identical to SEQ ID NO: 204950
  derived and/or modified sequence opt5 from neuraminidase__InfluenzaA__AFG99924

SEQ ID NO: 205087 - RNA, 1410 nt, Artificial Sequence
  derived and/or modified sequence opt5 from neuraminidase__InfluenzaA__AFG99935
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucguggagagaaauauuaccgaaaucgucuaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauauuugggugacaagagagcccuauguuuccugugacccuucuaagugcuaccaauucgcccuggggcagggaaccacacucaauaaccggcauagcaaugauaccgugcacgaccgcacgccguauagaacacugcugaugaacgaacucggcguccccuuucaucuggggaccaaacagguguguaucgccugguccucuagcuccugccacgauggaaaggcuuggcuucauguuugugugacaggccacgacgagaaugccaccgcuagcuucaucuacgauggccggcuggucgacucuauuggguccuggagcaaaaacauccuccgcacccaggaaucugagugcguguguauuaauggaacaugcacgguggucaugaccgauggcuccgccagcgagagagcggacacaaagauccuguuuauugaagaggggaaaaucguucacaucuccccucuuucuggaagcgcccaacauguggaagagugcuccuguuauccccgguacccuggcgugcgcugcgucuguagagauaacuggaaggggagcaaccggcccauuguggacaucaauaugaaggauuacucuauuguuuccagcuaugugugcucuggacuggucggcgacaccccgcgcaacaaugacagcuccucuagcuccuacuguagaaacccuaauaacgaaaaaggcagccacggggugaagggaugggcuuucgaugacggcaaugauguuuggauggggcggacaaucggagaggagcuccgcucuggcuaugaaaccuuuaaagugauugggggaugguccacgcccaacagcaagcugcagaucaauagacaggucaucguggaccggggcaacagaucuggcuacuccgggauuuucagcgucgagggaaaauccugcaucaaucgcuguuuuuauguggaacugauucggggcagaaagcaggagacagaaguuugguggaccucuaacagcaucguggucuucugcgggaccuccggaacauacggcaccgggucuuggccugauggcgccgacauuaaucucaugcccaucuga

SEQ ID NO: 205088 - RNA, 1410 nt, Artificial Sequence; identical to SEQ ID NO: 204950
  derived and/or modified sequence opt5 from neuraminidase__InfluenzaA__AFG99946

SEQ ID NO: 205089 - RNA, 1410 nt, Artificial Sequence
  derived and/or modified sequence opt5 from neuraminidase__InfluenzaA__AFG99957
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggccaugcugugcgaacccacaaucauugagagaaauaucaccgaaauuguguaucucacaaacaccacgaucgagaaggaaauuuguccuaaacuggcggaguaccggaauuggagcaagccccagugcaaaaucaccggguucgcuccuuuuuccaaggacaacucuauucgccuuagcgccggaggcgauaucugggugacaagagagcccuaugucuccugugacccugggaagugcuaccaauucgcccugggacagggcaccacacucaauaaccggcauucuaaugauaccgugcacgaccgcacgccguauagaacacugcugaugaacgaacucgggguucccuuucaucugggaaccaaacagguguguaucgcuuggagcuccagcucuugccacgauggcaaggccuggcuucaugucugugugacaggccacgacgagaaugcuaccgccuccuucauuuacgaugggcggcugguugacagcaucggaucuugguccaaaaacauucuccgcacccaggaaagcgagugcguguguaucaauggcacaugcacggucgugaugaccgaugggucugcguccgagagagccgacacaaagauucuguuuaucgaagagggaaaaaucgugcacauuagcccucuuuccggcucugcucaacaugucgaagagugcagcuguuauccccgguacccugggguucgcugcguguguagagauaacuggaagggauccaaccggcccaucguggacauuaaugucaaggauuacagcaucgugucuuccuauguuugcagcggccuggugggcgacaccccgcgcaaaaacgacucuagcuccucuagcuacuguagaaauccuaacaaugaaaaggggucccacggagucaaaggcugggccuucgaugacgggaacgauguguggaugggacggacaauuggcgaggagcuccgcagcggguaugaaaccuuuaagguuaucggaggcuggucuacgcccaauuccaaacugcagaucaacagacaggugauugucgaccggggcaauagaagcggguacucuggaaucuucuccguggagggcaagagcugcacaaaccgcuguuuuuaugucgaacugauucgggggagaaaacaggagaccgaagugugguggaccuccaauucuaucguuguguucugcggaacaagcggcaccuacgggacaggcuccuggccugauggagcugacauuaaccucaugcccaucuga

SEQ ID NO: 205090 - RNA, 1410 nt, Artificial Sequence; identical to SEQ ID NO: 204950
  derived and/or modified sequence opt5 from neuraminidase__InfluenzaA__AFG99968

SEQ ID NO: 205091 - RNA, 1410 nt, Artificial Sequence
  derived and/or modified sequence opt5 from neuraminidase__InfluenzaA__AFG99979
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcccugcgaaccuacaaucauugagagaaauaucaccgaaauuguguaucugacaaacaccacgaucgagaaggaaauuugucccaaacucgucgaguaccggaauuggagcaagccucagugcaaaaucaccggguucgcccccuuuuccaaggacaacucuauucgccugagcgcgggaggcgauaucugggugacaagagagccuuauguuuccugugacccggggaagugcuaccaauucgcucuuggacagggcaccacacugaauaaccggcauucuaaugauaccgugcacgaccgcacgcccuauagaacacuccugaugaacgaacugggggucccuuuucaucucggaaccaaacagguguguaucgccuggagcuccagcucuugccacgauggcaaggccuggcugcauguuugugugacaggccacgacgagaaugcuaccgccuccuucauuuacgaugggcggcuugucgacagcaucgugucuugguccaaaaacauucugcgcacccaggaaagcgagugcguguguaucaauggaacaugcacggucguuaugaccgauggcucugcuuccgagagagccgacacaaagauucucuuuaucgaagaggggaaaaucgugcacauuagcccccuguccggaucugcgcaacauguggaagagugcagcuguuauccucgguaccccggcguccgcugcguguguagagauaacuggaagggguccaaccggccgaucguugacauuaaugugaaggauuacagcaucgucucuuccuaugugugcagcggacuuguuggcgacaccccucgcaaaaacgacucuagcuccucuagcuacugucugaaucccaacaaugaaaagggcucccacggggugaaaggaugggccuucgaugacggcaacgaugucuggauggggagaacaauuggagaggagcuccggagcggcuaugaaaccuuuaaggugaucgggggauggucuacgccuaauuccaaacugcagacaaaccgccaggucaucguggacagaggcaaucggagcggcuacucugggauuuucuccguugagagcaaguccugcaucaacagauguuuuuauguggaacugauucgcggacggaaacaggagaccaaggucugguggaccucuaauagcaucgugguuuucugcggcacauccgggaccuacggaacaggcucuuggcccgauggggcugacauuaaccucaugcccaucuga

SEQ ID NO: 205092 - RNA, 1410 nt, Artificial Sequence
  derived and/or modified sequence opt5 from neuraminidase__InfluenzaA__AFG99990
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggccaugcugugcgaacccaagaucauugagagaaauaucacagaaauuguguaucucaccaacacaaccaucgagaaagaaauuuguccuaagcuggcggaguaccggaauuggagcaaaccccagugcaagaucacgggguucgcuccuuuuuccaaggacaacucuauucgccuuagcgccggaggcgauaucugggugaccagagagcccuaugucuccugugacccugggaaaugcuaccaauucgcccugggacagggcacaacccucaauaaccggcauucuaaugauacagugcacgaccgcaccccguauagaacgcugcugaugaacgaacucgggguucccuuucaucugggaacaaaacagguguguaucgcuuggagcuccagcucuugccacgauggcaaggccuggcuucaugucugugugaccggccacgacgagaaugcuacagccuccuucauuuacgaugggcggcugguugacagcaucggaucuugguccaagaacauucuccgcacccaggaaagcgagugcguguguaucaaugggaccugcacagucgugaugacggauggcucugcguccgagagagccgacaccaaaauucuguuuaucgaagagggaaagaucgugcacauuagcccucuuuccggcucugcucaacaugucgaagagugcagcuguuauccccgguacccugggguucgcugcguguguagagauaacuggaagggauccaaccggcccaucguggacauuaaugucaaagauuacagcaucgugucuuccuauguuugcagcggccuggugggcgacacaccgcgcaagaacgacucuagcuccucuagcuacuguagaaauccuaacaaugaaaaagggucccacggagucaagggcugggccuucgaugacgggaacgauguguggaugggacggaccauuagcgaggagcuccgcucuggcuaugaaacauuuaaaguuaucgggggaugguccaagcccaauagcaaacugcagaucaacagacaggugauugucgaccggggcaauagaucuggcuacuccgggaucuucagcguggagggaaaguccugcauuaaccgcuguuuuuaugucgaacugauccggggcagaaagcaggagaccgaagugugguggacgucuaauagcauuguuguguucugcgggacauccggaaccuacggcaccgggucuuggccugauggcgcugacaucaaccucaugcccauuuga

SEQ ID NO: 205093 - RNA, 1410 nt, Artificial Sequence
  derived and/or modified sequence opt5 from neuraminidase__InfluenzaA__AFH00002
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugauccccugccagccuacaauuaucgaaagaaacauuaccgagaucguguaucugacaaauaccacgauugaaaaggagaucugucccaaacucgucgaauaccggaacugguccaagccucaaugcaaaauuaccggguucgcccccuuuucuaaggacaauagcauccgccuguccgcgggaggcgauaucugggugacaagagagccuuauguuucuugugacccggggaagugcuaccaguucgcucuuggacagggcaccacacugaacaaucggcauagcaacgauaccgugcacgaccgcacgcccuauagaacacuccugaugaaugagcugggggucccuuuucaucucggaaccaaacagguguguauugccugguccuccucuuccugccacgauggcaaggccuggcugcauguuugugugacaggccacgacgaaaacgcuaccgccagcuucaucuacgaugggcggcuugucgacucuauuggauccuggagcaaaaauauccugcgcacccaagagucugaaugcguguguauuaacggcacaugcgcuguggucaugacggauggguccgccagcgagagagcggacaccaagauccucuuuaucgaggaaggaaaaguugugcacauuagcccccugucuggcagcgcccagcauguggaggaaugcuccuguuauccucgguaccccgggguccgcugcguguguagagauaauuggaagggaagcaaccggccgaucguugacauuaacgugaagaauuacucuaucgucuccagcuaugugugcucuggccuuguuggcgauacaccucgcaaaaacgacagcuccucuagcuccuacuguagaaaucccaacaaugagaaggggagccacggagugaaaggcugggcuuucgacgaugggaacgacgucuggaugggacggaccauuucugaggaacugcgcuccggcuaugagacauuuaaggugaucgggggauggagcaccccuaauucuaaacuccagaucaacagacaggucauuguggauuccggcaaucggagcggcuacuccgggaucuucucuguugaaggaaagagcugcauuaacagauguuuuuauguggagcugauccgcggccggaaacaagaaacgaaggucugguggacauccaauucuauugugguuuucugcgggaccagcggaaccuacggcacaggguccuggcccgacggcgccgauaucaaccugaugcccauuuga

SEQ ID NO: 205094 - RNA, 1410 nt, Artificial Sequence; identical to SEQ ID NO: 198209
  derived and/or modified sequence opt5 from neuraminidase__InfluenzaA__AFH00013

SEQ ID NO: 205095 - RNA, 1410 nt, Artificial Sequence
  derived and/or modified sequence opt5 from neuraminidase__InfluenzaA__AFH00024
augaaccccaaucagaagaucauuaccaucggcagcgugucccugacaauugccacgaucugcuuccucaugcaaauuaccauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggucgaguaccggaauuggagcaagccccagugcaaaaucacaggguucgcuccuuuuuccaaggacaacucuauucgccuuagcgccggaggcgauaucugggugaccagagagcccuauguuuccugugacccugggaagugcuaccaauucgcgcugggacagggcacaacccucaauaaccggcauucuaaugauacggugcacgaccgcacaccguauagaacccugcugaugaacgaacucgggguccccuuucaucugggaacaaaacagguguguaucgcuuggagcuccagcucuugccacgauggcaaggccuggcuucauguuugugugaccggccacgacgagaaugccaccgcuuccuucauuuacgaugggcggcuggucgacagcaucggaucuugguccaaaaacauucuccgcacacaggaaagcgagugcguguguaucaauggcacgugcaccguggucaugacagaugggucugccuccgagagagcugacaccaagauucuguuuaucgaagagggacggaucguucacauuagcccucuuuccggcucugcccaacauguggaagagugcagcuguuauccccgcuacccuggggugagaugcgucugucgggauaacuggaaaggauccaaccgccccaucguggacauuaauguuaaggauuacagcaucgugucuuccuaugucugcagcggccuggugggcgacacaccgagaaagaacgacucuagcuccucuagcuacugucggaauccuaacaaugaaaaagggucccacggaguuaagggcugggcguucgaugacgggaacgauguguggaugggacgcaccauuagcgaggagcucagaucuggcuaugaaacguuuaaagucaucgggggaugguccacacccaauagcaagcugcagaucaacagacaggugauugucgaccggggcaaucgcucuggcuacuccgggaucuucagcguggagggaaaauccugcauuaaccgguguuuuuauguugaacugaucagaggccgcaagcaggagaauaaagugugguggaccucuaacagcauugucguguucugcgggaccuccggaacauacggcaccgggucuuggccugauggcgccgacaucaaucucaugcccauuuga

SEQ ID NO: 205096 - RNA, 1410 nt, Artificial Sequence; identical to SEQ ID NO: 198209
  derived and/or modified sequence opt5 from neuraminidase__InfluenzaA__AFH00035

SEQ ID NO: 205097 - RNA, 1410 nt, Artificial Sequence; identical to SEQ ID NO: 198209
  derived and/or modified sequence opt5 from neuraminidase__InfluenzaA__AFH00046

SEQ ID NO: 205098 - RNA, 1410 nt, Artificial Sequence
  derived and/or modified sequence opt5 from neuraminidase__InfluenzaA__AFH00057
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacguccuccgcacccaggaaagcgagugcguguguauuaauggcacaugcacgguggucaugaccgaugggucugccuccgagagagcggacacaaagauccuguuuauugaagagggaaaaaucguucacaucagcccucuuuccggcucugcccaacauguggaagagugcagcuguuauccccgguacccuggggugcgcugcgucuguagagauaacuggaagggauccaaccggcccauuguggacaucaauguuaaggauuacagcauugugucuuccuaugucugcagcggccuggugggcgacaccccgcgcaaaaacgacucuagcuccucuagcuacuguagaaauccuaacaaugaaaaggggucccacggaguuaaaggcugggcuuucgaugacgggaacgauguguggaugggacggacaaucagcgaggagcuccgcucuggcuaugaaaccuuuaaggucauugggggaugguccaaucccaacagcaaacugcagaucaauagacaggugaucgucgaccggggcaacagaucuggcuacuccgggauuuucagcguggagggaaaguccugcaucaaucgcuguuuuuauguugaacugauucggggcagaaaacaggagacggaagugugguggacaucuaacagcaucgucguguucugcgggaccuccggaaccuacggcacagggucuuggccugauggcgccgacauuaaucucaugcccaucuga

SEQ ID NO: 205099 - RNA, 1410 nt, Artificial Sequence; identical to SEQ ID NO: 198209
  derived and/or modified sequence opt5 from neuraminidase__InfluenzaA__AFH00068

SEQ ID NO: 205100 - RNA, 1410 nt, Artificial Sequence
  derived and/or modified sequence opt5 from neuraminidase__InfluenzaA__AFH00079
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguagaaauccuaacaaugaaaaggggucccacggagugaaaggcugggcuuucgaugacgggaacgauguuuggaugggacggacaauuagcgaggagcuccgcucuggcuaugaaaccuuuaaggugaucgaggggugguccaaacccaauagcaagcugcagaucaacagacaggucauuguggaccggggaaauagaucuggcuacuccggcaucuucagcgucgaagggaaauccugcauuaaccgcuguuuuuauguggagcugauccggggaagaaagcaggaaacggagguuugguggacaucuaauagcauuguggucuucugcggcaccuccgggaccuacggaacaggcucuuggccugauggggccgacaucaaccucaugcccauuuga

SEQ ID NO: 205101 - RNA, 1410 nt, Artificial Sequence
  derived and/or modified sequence opt5 from neuraminidase__InfluenzaA__AFH00090
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguuggaauccuaacaaugaaaaggggucccacggagugaaaggcugggcuuucgaugacgggaacgauguuuggaugggaagaacaauuagcgaggagcuccggucuggcuaugaaaccuuuaaggugaucgggggaugguccaaacccaauagcaagcugcagaucaaccgccaggucauuguggacagaggcaaucggucuggcuacuccgggaucuucagcgucgagggaaaauccugcauuaacagauguuuuuauguggaacugauccgcggccggaagcaggagacggaaguuugguggacaucuaauagcauuguggucuucugcgggaccuccggaaccuacggcacagggucuuggccugauggcgccgacaucaaccucaugcccauuuga

SEQ ID NO: 205102 - RNA, 1410 nt, Artificial Sequence
  derived and/or modified sequence opt5 from neuraminidase__InfluenzaA__AFH00101
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaagauucuccgcacccaggaaagcgagugcgucuguaucaacggcacaugcacgguggugaugaccgaugggucugccuccgagagagcggacacaaaaauucuguuuaucgaagagggaaagaucguccacauuagcccucuuuccggcucugcccaacauguugaagagugcagcuguuauccccgguacccuggggugcgcugcguguguagagauaauuggaagggauccaaccggcccaucgucgacauuaacgugaaagauuacagcaucguuucuuccuaugugugcagcggccuggucggcgacaccccgcgcaagaaugacucuagcuccucuagcuacuguagaaacccuaauaacgaaaaagggucccacggagugaagggcugggcuuucgaugacgggaaugauguuuggaugggacggacaauuagcgaggagcuccgcucuggcuaugaaaccuuuaaagugaucgggggaugguccaagcccaacagcaaacugcagaucaauagacaggucauuguggaccggggcaacagaucuggcuacuccgggaucuucagcgucgagggaaaguccugcauuaaucgcuguuuuuauguggaacugauccggggcagaaagcaggagacggaaguuugguggacaucuaacagcauuguggucuucugcgggaccuccggaaccuacggcacagggucuuggccugauggcgccgacaucaaucucaugcccauuuga

SEQ ID NO: 205103 - RNA, 1410 nt, Artificial Sequence; identical to SEQ ID NO: 198125
  derived and/or modified sequence opt5 from neuraminidase__InfluenzaA__AFH00112

SEQ ID NO: 205104 - RNA, 1410 nt, Artificial Sequence; identical to SEQ ID NO: 198125
  derived and/or modified sequence opt5 from neuraminidase__InfluenzaA__AFH00123

SEQ ID NO: 205105 - RNA, 1410 nt, Artificial Sequence
  derived and/or modified sequence opt5 from neuraminidase__InfluenzaA__AFH00156
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucauugacaucaaugucaaggauuacagcauugugucuuccuauguuugcagcggccuggugggcgacaccccgcgcaaaaacgacucuagcuccucuagcuacuguagaaauccuaacaaugaaaaggggucccacggagucaaaggcugggcuuucgaugacgggaacgauguguggaugggacggacaaucagcgaggagcuccgcucuggcuaugaaaccuuuaagguuaucgggggaugguccaaacccaauagcaagcugcagauuaacagacaggugaucgucgaccggggcaauagaucuggcuacuccgggauuuucagcguggagggaaaauccugcaucaaccgcuguuuuuaugucgaacugauucggggcagaaagcaggagacggaagugugguggacaucuaauagcaucguuguguucugcgggaccuccggaaccuacggcacagggucuuggccugauggcgccgacauuaaccucaugcccaucuga

SEQ ID NO: 205106 - RNA, 1410 nt, Artificial Sequence
  derived and/or modified sequence opt5 from neuraminidase__InfluenzaA__AFH00167
augaaccccaaucagaagaucauuaccaucggcagcgugucccugacaauugccacgaugugcuuccucaugcaaaucgcuauucuggucaccacaguuacccuucacuuuaaacaguacgaguguaacucuccuccgaauaaccaggugaugcugugcgaacccacaaucaucgagagaaauauuaccgaaaucguguaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauauuugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucaucuacgaugggcggcugguggacagcauuggaucuugguccaaaaacauccuccgcacccaggaaagcgagugcgucuguauuaauggcacaugcacgguggugaugaccgaugggucugccuccgagagagcggacacaaagauccuguuuauugaagagggaaaaaucguccacaucagcccucuuuccggcucugcccaacauguugaagagugcagcuguuauccccgguacccuggggugcgcugcguguguagagauaacuggaagggauccaaccggcccauugucgacaucaaugugaaggauuacagcauuguuucuuccuaugugugcagcggccuggucggcgacaccccgcgcaaaaacgacucuagcuccucuagcuacuguagaaauccuaacaaugaaaaggggucccacggagugaaaggcugggcuuucgaugacgggaacgauguuuggaugggacggacaaucagcgaggagcuccgcucuggcuaugaaaccuuuaaggugauugggggaugguccaaacccaauagcaagcugcagaucaacagacaggucaucguggaccggggcaauagaucuggcuacuccgggauuuucagcgucgagggaaaauccugcaucaaccgcuguuuuuauguggaacugauucggggcagaaagcaggagacggaaguuugguggacaucuaauagcaucguggucuucugcgggaccuccggaaccuacggcacagggucuuggccugauggcgccgacauuaaccucaugcccaucuga

SEQ ID NO: 205107 - RNA, 1410 nt, Artificial Sequence; identical to SEQ ID NO: 205105
  derived and/or modified sequence opt5 from neuraminidase__InfluenzaA__AFH00178

SEQ ID NO: 205108 - RNA, 1410 nt, Artificial Sequence
  derived and/or modified sequence opt5 from neuraminidase__InfluenzaA__AFH00189
augaaccccaaucagaagaucauuaccaucggcagcgugucccugacaauugccacgaucugcuuccucaugcaaauugcuauccuggucaccacaguuacccuucacuuuaaacaguacgaguauaacucuccuccgaauaaccaggugaugcugugugaacccaagaucauugagagaaauaucacagaaauuguguaccucaccaacacaaccaucgagaaagaaauuugcccuaagcuggccgaguaucggaauuggagcaaaccccaguguaagaucacgggguucgcgccuuuuuccaaggacaacucuauucgccuuagcgcuggaggcgauaucugggucaccagagagcccuacguguccugcgacccugggaaauguuaucaauucgcccugggacagggcacaacccucaauaaccggcauucuaaugauacaguucacgaccgcaccccguacagaacgcugcugaugaacgaacucggggugcccuuucaucugggaacaaagcaggucugcaucgccuggagcuccagcucuugucacgauggcaaggcuuggcuucaugugugcguuaccggccacgacgagaaugccacagcuuccuucauuuaugaugggcggcugguggacagcaucggaucuugguccaaaaacauucuccgcacccaggaaagcgagugugucugcaucaauggcaccuguacaguggugaugacggaugggucugccuccgagagagcggacaccaaaauucuguuuaucgaagagggaaagaucguccacauuagcccucuuuccggcucugcccaacauguugaagagugcagcugcuacccccgguacccuggggugcgcugugugugcagagauaacuggaagggauccaaccggcccaucgucgacauuaaugugaaagauuauagcaucguuucuuccuacguguguagcggccuggucggcgacacaccgcgcaagaacgacucuagcuccucuagcuauugcagaaauccuaacaaugaaaaagggucccacggagugaagggcugggcuuucgaugacgggaacgauguuuggaugggacggaccauuagcgaggagcuccgcucuggcuacgaaacauuuaaagugaucgggggaugguccaagcccaauagcaaacugcagaucaacagacaggucauuguggaccggggcaauagaucuggcuauuccgggaucuucagcgucgagggaaaguccuguauuaaccgcugcuuuuacguggaacugauccggggcagaaagcaggagaccgaaguuugguggacgucuaauagcauuguggucuucugugggacauccggaaccuauggcaccgggucuuggccugauggcgccgacaucaaccucaugcccauuuga

SEQ ID NO: 205109 - RNA, 1410 nt, Artificial Sequence; identical to SEQ ID NO: 198209
  derived and/or modified sequence opt5 from neuraminidase__InfluenzaA__AFH00200

SEQ ID NO: 205110 - RNA, 1410 nt, Artificial Sequence; identical to SEQ ID NO: 205106
  derived and/or modified sequence opt5 from neuraminidase__InfluenzaA__AFH00211

SEQ ID NO: 205111 - RNA, 1410 nt, Artificial Sequence
  derived and/or modified sequence opt5 from neuraminidase__InfluenzaA__AFH00222
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaauaacaccguucacgaucgcacgccguauagaacacugcugaugaaugaacucggggugcccuuucaucugggaaccaaacaggucuguaucgccuggagcuccagcucuugccacgacggcaaggcuuggcuucauguguguguuacaggccacgaugagaacgccaccgcuuccuucauuuacgacgggcggcugguggauagcaucggaucuugguccaaaaauauucuccgcacccaggaaagcgagugcgucuguaucaacggcacaugcacgguggugaugaccgacgggucugccuccgagagagcggauacaaagauucuguuuaucgaagagggaaaaaucguccacauuagcccucuuuccggcucugcccaacauguugaagagugcagcuguuauccccgguacccuggggugcgcugcguguguagagacaacuggaagggauccaaucggcccaucgucgauauuaacgugaaggacuacagcaucguuucuuccuaugugugcagcggccuggucggcgauaccccgcgcaaaaaugacucuagcuccucuagcuacuguagaaacccuaauaacgaaaaggggucccacggagugaaaggcugggcuuucgacgaugggaaugacguuuggaugggacggacaauuagcgaggagcuccgcucuggcuaugaaaccuuuaaggugaucgggggaugguccaaacccaacagcaagcugcagaucaauagacaggucauuguggaucggggcaacagaucuggcuacuccgggaucuucagcgucgagggaaaauccugcauuaaucgcuguuuuuauguggaacugauccggggcagaaagcaggagacggaaguuugguggacaucuaacagcauuguggucuucugcgggaccuccggaaccuacggcacagggucuuggccugacggcgccgauaucaaucucaugcccauuuga

SEQ ID NO: 205112 - RNA, 1410 nt, Artificial Sequence; identical to SEQ ID NO: 198125
  derived and/or modified sequence opt5 from neuraminidase__InfluenzaA__AFH00233

SEQ ID NO: 205113 - RNA, 1410 nt, Artificial Sequence
  derived and/or modified sequence opt5 from neuraminidase__InfluenzaA__AFH00244
augaaccccaaucagaagaucauuaccaucggcagcgugucccugacaauugccacgaucugcuuccucaugcaaauugcuauccuggucaccacaguuacccuuuacuuuaaacaguaugaguguaacucuccuccgagcaaucaggugaugcugugcgaacccacaaucguggagagaaacauuaccgaaaucgucuaccucacaaauaccacgauugagaaggaaaucuguccuaaacuggccgaguaucggaacugguccaagccccagugcaaaauuaccggguucgcgccuuuuucuaaggacaauagcauccgccuuuccgcuggaggcgauauuugggugacaagagagcccuacguuucuugugacccugggaagugcuaucaauucgcccugggacagggcaccacacucaacaaucggcacagcaacgauaccgugcaugaccgcacgccguacagaacacugcugaugaaugaacucgggguccccuuucaccugggaaccaaacagguguguaucgccugguccucuagcuccugccaugauggcaaggcuuggcuucacguuugugugacaggccaugacgagaacgccaccgcuagcuucaucuaugaugggcggcuggucgacucuauuggauccuggagcaaaaauauccuccgcacccaggaaucugagugcguguguauuaacggcacaugcacgguggucaugaccgauggguccgccagcgagagagcggacacaaagauccuguuuauugaagagggaaaaaucguucacaucuccccucuuucuggcagcgccaagcacguggaagagugcuccuguuacccccgguacccuggggugcgcugcgucuguagagauaauuggaagggaagcaaccggcccauuguggacaucaacguuaaagauuauucuauuguguccagcuacgucugcucuggccuggugggcgacaccccgcgcaagaaugacagcuccucuagcuccuauuguagaaacccuaauaacgaaaaagggagccauggaguuaagggcugggcuuucgaugacgggaaugauguguggaugggacggacaaucucugaggagcuccgcuccggcuacgaaaccuuuaaagucauugggggauggagcaagcccaacucuaaacugcaaaucaauagacaggugaucgucgaccggggcaacagauccggcuauagcgggauuuucuccguggagggaaagucuugcaucaaucgcuguuuuuacguugaacugauucggggcagaaagcaggagacggaagugugguggacaagcaacuccaucgucguguucugcgggaccucuggaaccuauggcacagggagcuggccugauggcgccgacauuaaucucaugcccaucuga

SEQ ID NO: 205114 - RNA, 1410 nt, Artificial Sequence; identical to SEQ ID NO: 198209
  derived and/or modified sequence opt5 from neuraminidase__InfluenzaA__AFH00255

SEQ ID NO: 205115 - RNA, 1410 nt, Artificial Sequence; identical to SEQ ID NO: 198209
  derived and/or modified sequence opt5 from neuraminidase__InfluenzaA__AFH00266

SEQ ID NO: 205116 - RNA, 1410 nt, Artificial Sequence
  derived and/or modified sequence opt5 from neuraminidase__InfluenzaA__AFH00277
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacuguagaaagccuaacaaugaaaaagggagccacggacucaagggcugggcuuucgaugacgggaacgauguguggaugggacggacaauuucugaggagcugcgcuccggcuaugaaaccuuuaaaguuaucgggggauggagcaagcccaauucuaaacugcagaucaacagacaggugauugucgaccggggcaauagauccggcuacagcgggaucuucuccguggagggaaagucuugcauuaaccgcuguuuuuaugucgaacucauccggggcagaaagcaggagacggaagugugguggacaagcaauuccauuguuguguucugcgggaccucuggaaccuacggcacagggagcuggccugauggcgccgacaucaaccugaugcccauuuga

SEQ ID NO: 205117 - RNA, 1410 nt, Artificial Sequence; identical to SEQ ID NO: 198209
  derived and/or modified sequence opt5 from neuraminidase__InfluenzaA__AFH00288

SEQ ID NO: 205118 - RNA, 1410 nt, Artificial Sequence; identical to SEQ ID NO: 205041
  derived and/or modified sequence opt5 from neuraminidase__InfluenzaA__AFH00299

SEQ ID NO: 205119 - RNA, 1410 nt, Artificial Sequence
  derived and/or modified sequence opt5 from neuraminidase__InfluenzaA__AFH00310
augaaccccaaucagaagaucauuaccaucggcagcgugucccugacaauugccacgaucugcuuccucaugcaaauugcuauccuggucaccacaguuacccuucacuuuaaacaguacgaguguucuagcuccccuaacaaucaggugaucccgugccagcccacaauuaucgaaagaaacauuaccgagaucguguaucugacaaauaccacgauugaaaaggagaucuguccuaaacucgucgaauaccggaacuggucuaagccccaaugcaaaauuaccggguucgccccuuuuagcaaggacaauuccauccgccugucugcgggaggcgauaucugggugacaagagagcccuauguuagcugugacccugggaagugcuaccaguucgcucuuggacagggcaccacacugaacaaucggcauuccaacgauaccgugcacgaccgcacgccguauagaacacuccugaugaaugagcuggggguccccuuucaucucggaaccaaacagguguguauugccuggucuagcuccagcugccacgauggcaaggccuggcugcauguuugugugacaggccacgacgaaaacgcuaccgccucuuucaucuacgaugggcggcuugucgacuccauuggaagcuggucuaaaaauauccugcgcacccaagaguccgaaugcguguguauuaacggcacaugcacgguggucaugaccgaugggagcgcuuccgagaaggccgacacaaaaauccucuuuaucgaggaaggaaagguugugcacauuucuccucugagcggcuccgcgcagcauguggaggaaugcagcuguuaucccagauacccugggguccggugcgugugucgcgauaauuggaagggaucuaacagacccaucguugacauuaacgugaaaaauuacuccaucgucagcucuuaugugugcagcggccuuguuggcgauaccccgcggaagaacgacuccucuagcuccagcuacugucgcaauccuaacaaugagaaagggucucacggagugaagggcugggccuucgacgaugggaacgacgucuggaugggaagaacaauuuccgaggaacugcggagcggcuaugagaccuuuaaagugaucgggggauggucuacgcccaauuccaagcuccagaucaaccgccaggucauuguggauagcggcaauagauccggcuacucugggaucuucagcguugaaggaaaauccugcauuaaccgguguuuuuauguggagcugaucagaggccgcaagcaagaaacaaaggucugguggaccucuaauagccuggugguuuucugcgggaccuccggaacauacggcaccgggagcuggccugacggcgcugauauuaaccucaugcccaucuga

SEQ ID NO: 205120 - RNA, 1410 nt, Artificial Sequence; identical to SEQ ID NO: 205119
  derived and/or modified sequence opt5 from neuraminidase__InfluenzaA__AFH00321

SEQ ID NO: 205121 - RNA, 1410 nt, Artificial Sequence
  derived and/or modified sequence opt5 from neuraminidase__InfluenzaA__AFH00332
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagccacugucucaauccuaacaaugaagaagggggacauggcgugaaggggugggcuuucgaugacggaaacgauguuuggaugggcagaacaauuuccgagaaacugcggagcggguacgagaccuuuaaggugaucggaggcuggucuaaacccaauuccaagcugcagaucaaccgccaggucauuguggacagaggcaaucggagcggguauucuggaaucuucuccgucgagggcaaagggugcauuaacagauguuuuuacguggaacucauccgcggacggaagcaggagacggaaguuugguggacaagcaauuccauuguggucuucugcggcaccucugggaccuauggcacaggaagcuggccugauggcgccgacaucaaccugaugcccauuuga

SEQ ID NO: 205122 - RNA, 1410 nt, Artificial Sequence
  derived and/or modified sequence opt5 from neuraminidase__InfluenzaA__AFH00343
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggccaugcugugcgaacccacaaucauugagagaaacaucaccgaaauuguguaucucacaaauaccacgaucgagaaggaaauuuguccuaaacuggcggaguaccggaacugguccaagccccagugcaaaaucaccggguucgcuccuuuuucuaaggacaauagcauucgccuuuccgccggaggcgauaucugggugacaagagagcccuaugucucuugugacccugggaagugcuaccaauucgcccugggacagggcaccacacucaacaaucggcauagcaacgauaccgugcacgaccgcacgccguauagaacacugcugaugaaugaacucgggguucccuuucaucugggaaccaaacagguguguaucgcuugguccucuagcuccugccacgauggcaaggccuggcuucaugucugugugacaggccacgacgagaacgcuaccgccagcuucauuuacgaugggcggcugguugacucuaucggauccuggagcaaaaauauucuccgcacccaggaaucugagugcguguguaucaacggcacaugcacggucgugaugaccgauggguccgcgagcgagagagccgacacaaagauucuguuuaucgaagagggaaaaaucgugcacauuuccccucuuucuggcagcgcucaacaugucgaagagugcuccuguuauccccgguacccugggguucgcugcguguguagagauaauuggaagggaagcaaccggcccaucguggacauuaacgucaaggauuacucuaucguguccagcuauguuugcucuggccuggugggcgacaccccgcgcaaaaaugacagcuccucuagcuccuacuguagaaacccuaauaacgaaaaggggagccacggagucaaaggcugggccuucgaugacgggaaugauguguggaugggacggacaauuucugaggagcuccgcuccggcuaugaaaccuuuaagguuaucgggggauggagcaaacccaacucuaagcugcagaucaauagacaggugauugucgaccggggcaacagauccggcuacagcgggaucuucuccguggagggaaaaucuugcauuaaucgcuguuuuuaugucgaacugauccggggcagaaagcaggagacggaagugugguggacaagcaacuccauuguuguguucugcgggaccucuggaaccuacggcacagggagcuggccugauggcgcugacaucaaucucaugcccauuuga

SEQ ID NO: 205123 - RNA, 1410 nt, Artificial Sequence
  derived and/or modified sequence opt5 from neuraminidase__InfluenzaA__AFH00354
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccaagauuguguaucucacaaacaccacgaucgaaaaagagauuuguccuaagcuggccgaauaccggaauuggagcaaaccccagugcaagaucaccggguucgcgccuuuuuccaaggacaacucuauucgccuuagcgcuggaggcgauaucugggucacaagagagcccuauguguccugugacccugggaaaugcuaccaauucgcccugggacagggcaccacacucaauaaccggcauucuaaugauaccguucacgaccgcacgccguauagaacacugcugaugaacgagcucggggugcccuuucaucugggaaccaagcaggucuguaucgccuggagcuccagcucuugccacgauggcaaggcuuggcuucauguguguguuacaggccacgacgaaaaugccaccgcuuccuucauuuacgaugggcggcugguggacagcaucggaucuugguccaaaaacauucuccgcacccaggagagcgaaugcgucuguaucaauggcacaugcacgguggugaugaccgaugggucugccuccgagagagcggacacaaaaauucuguuuaucgaggaaggaaagaucguccacauuagcccucuuuccggcucugcccaacauguugaggaaugcagcuguuauccccgguacccuggggugcgcugcguguguagagauaacuggaagggauccaaccggcccaucgucgacauuaaugugaaagauuacagcaucguuucuuccuaugugugcagcggccuggucggcgacaccccgcgcaagaacgacucuagcuccucuagcuacugucucaauccuaacaaugaggaagggggacacggcgugaaagggugggcuuucgaugacggaaacgauguuuggaugggcagaacaauuuccgagaagcugcggagcggguaugagaccuuuaaagugaucggaggcuggucuaagcccaauuccaaacugcagaucaaccgccaggucauuguggacagaggcaaucggagcggguacucuggaaucuucuccgucgaaggcaagagcugcgugaacagauguuuuuauguugagcucauucgcgggcggaagcaggaaacggaggugugguggacauccaauucuaucgucguguucugcggaaccagcggcaccuacgggacaggcuccuggccugauggagccgacauuaaccugaugcccaucuga

SEQ ID NO: 205124 - RNA, 1410 nt, Artificial Sequence; identical to SEQ ID NO: 198004
  derived and/or modified sequence opt5 from neuraminidase__InfluenzaA__AFH00365

SEQ ID NO: 205125 - RNA, 1410 nt, Artificial Sequence
  derived and/or modified sequence opt5 from neuraminidase__InfluenzaA__AFH00376
augaaccccaaucagaagaucauuaccaucggcagcgugucccugacaauugccacgaucugcuuccucaugcaaauugcuauccuggucaccacaguuacccuucacuuuaaacagugugagugcaacucuccuccgaauaaccaggugaugcugugugaacccacaaucauugagagaaauaucaccgaaauuguguaccucacaaacaccacgaucgagaaggaaauuugcccuaaacuggccgaguaucggaauuggagcaagccccaguguaaaaucaccggguucgcgccuuuuuccaaggacaacucuauucgccuuagcgcuggaggcgauaucugggucacaagagagcccuacguguccugcgacccugggaaguguuaucaauucgcccugggacagggcaccacacucaauaaccggcauucuaaugauaccguucacgaccgcacgccguacagaacacugcugaugaacgaacucggggugcccuuucaucugggaaccaaacaggucugcaucgccuggagcuccagcucuugucacgauggcaaggcuuggcuucaugugugcguuacaggccacgacgagaaugccaccgcuuccuucauuuaugaugggcggcugguggacagcaucggaucuugguccaaaaacauucuccgcacccaggaaagcgagugugucugcaucaauggcacaugcacgguggugaugaccgaugggucugccuccggcagagcggacacaaagauucuguuuaucgaggaaggaaaaaucguccacauuagcccucuuuccgggucugcccaacauguugaggaauguagcugcuacccccgguauccuggagugcgcugugugugcagagauaacuggaagggcuccaaccggcccaucgucgacauuaaugugaaggauuacagcaucguuucuuccuacguguguagcggccuggucggggacaccccgcgcaaaaacgacucuagcuccucuagcuauugccucaauccuaacaaugaggaaggaggccacggggugaagggaugggcuuucgaugacggcaacgauguuuggauggggagaacaauuuccgagaaacugcggagcggauacgagaccuuuaaggugaucggcggcuggucuaaacccaauuccaagcugcagaucaaccgccaggucauuguggacagagggaaucggagcggauauucuggcaucuucuccgucgaagggaaaagcuguauuaacagaugcuuuuacguggagcucauccgcggacggaagcaggaaacggagguuugguggacauccaauucuauuguggucuucuguggcaccagcgggaccuauggcacaggauccuggccugauggcgccgacaucaaccugaugcccauuuga

SEQ ID NO: 205126 - RNA, 1410 nt, Artificial Sequence
  derived and/or modified sequence opt5 from neuraminidase__InfluenzaA__AFH00387
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucucuuccuggagcaaaaacauucuccgcacccaggaaucugagugcgucuguaucaaugggacaugcacgguggugaugaccgacggauccgccagcgagagagcggauacaaagauucuguuuaucgaagagggcaaaaucguccacauuuccccucuuucugggagcgcccaacauguugaagagugcuccuguuauccccgguacccuggagugcgcugcguguguagagacaacuggaagggcagcaaccggcccaucgucgauauuaaugugaaggacuacucuaucguuuccagcuaugugugcucugggcuggucggagacaccccgcgcaaaaacgauagcuccucuagcuccuacugucucaauccuaacaaugaagagggcggccacggggugaagggaugggcuuucgacgauggcaacgacguuuggauggggagaacaauuagcgagaaacugcggucuggauaugaaaccuuuaaggugaucggcgggugguccaaacccaauagcaagcugcagaucaaccgccaggucauuguggauagaggaaaucggucuggcuacuccggcaucuucagcgucgaggggaaauccugcgugaacagauguuuuuauguugaacucauucgcggacggaagcaggagacggaagugugguggacaucuaauagcaucgucguguucugcggcaccuccgggaccuacggaacaggcucuuggccugacggggccgauauuaaccugaugcccaucuga

SEQ ID NO: 205127 - RNA, 1410 nt, Artificial Sequence
  derived and/or modified sequence opt5 from neuraminidase__InfluenzaA__AFH00398
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacugucucaauccuaacaaugaagaagggggacacggcgugaaggggugggcuuucgaugacggaaacgauguuuggaugggcagaacaauuuccgagaaacugcggagcggguaugagaccuuuaaggugaucggaggcuggucuaaacccaauuccaagcugcagaucaaccgccaggucauuguggacagaggcaaucggagcggguacucuggaaucuucuccgucgagggcaaaagcugcgugaacagauguuuuuauguugaacucauucgcgggcggaagcaggagacggaagugugguggacauccaauucuaucgucguguucugcggaaccagcggcaccuacggggccggcuccuggccugauggagcugacauuaaccugaugcccaucuga

SEQ ID NO: 205128 - RNA, 1410 nt, Artificial Sequence
  derived and/or modified sequence opt5 from neuraminidase__InfluenzaA__AFH00409
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacaaugagaacgccaccgcuuccuucauuuacgacgggcggcugguggauagcaucggaucuugguccaaaaauauucuccgcacccaggaaagcgagugcgucuguaucaacggcacaugcacgguggugaugaccgacgggucugccuccggcagagcggauacaaagauucuguuuaucgaggaaggaaaaaucguccacauuagcccucuuuccgggucugcccaacauguugaggaaugcagcuguuauccccgguacccuggagugcgcugcguguguagagacaacuggaagggcuccaaucggcccaucgucgauauuaacgugaaggacuacagcaucguuucuuccuaugugugcagcggccuggucggggauaccccgcgcaaaaaugacucuagcuccucuagcuacugucucaacccuaauaacgaggaaggaggccacggggugaagggaugggcuuucgacgauggcaaugacguuuggauggggagaacaauuuccgagaaacugcggagcggauaugagaccuuuaaggugaucggcggcuggucuaaacccaacuccaagcugcagaucaaucgccaggucauuguggauagagggaaccggagcggauacucuggcaucuucuccgucgaagggaaaagcugcauuaauagauguuuuuauguggagcucauccgcggacggaagcaggaaacggagguuugguggacauccaacucuauuguggucuucugcggcaccagcgggaccuacggcacaggauccuggccugacggcgccgauaucaaucugaugcccauuuga

SEQ ID NO: 205129 - RNA, 1410 nt, Artificial Sequence; identical to SEQ ID NO: 198004
  derived and/or modified sequence opt5 from neuraminidase__InfluenzaA__AFH00420

SEQ ID NO: 205130 - RNA, 1410 nt, Artificial Sequence; identical to SEQ ID NO: 198137
  derived and/or modified sequence opt5 from neuraminidase__InfluenzaA__AFH00431

SEQ ID NO: 205131 - RNA, 1410 nt, Artificial Sequence
  derived and/or modified sequence opt5 from neuraminidase__InfluenzaA__AFH00442
augaaccccaaucagaagaucauuaccaucggcagcgugucccugacaauugccacgaucugcuuccucaugcaaauugcuauccuggucaucaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugggaagugcuaccaauucgcccugggacagggcacaacccucaauaaccggcauucuaaugauacaguucacgaccgcaccccguauagaacgcugcugaugaacgaacucggggugcccuuucaucugggaacaaaacaggucuguauugccuggagcuccagcucuugccacgauggcaaggcuuggcuucauguguguguuaccggccacaaugagaacgccacagcuuccuucaucuacgacgggcggcugguggauagcauuggaucuugguccaaaaauauccuccgcacccaggaaagcgagugcgucuguauuaacggaaccugcacaguggugaugacggacgggucugccuccggcagagcggauaccaagauccuguuuaucgaggaaggcaaaauuguccacaucagcccucuuuccgggucugcccaacauguugaggaaugcagcuguuauccccgguacccuggagugcgcugcguguguagagacaacuggaagggcuccaaucggcccauugucgauaucaacgugaaggacuacagcauuguuucuuccuaugugugcagcggccuggucggggauacaccgcgcaaaaaugacucuagcuccucuagccacugucucaacccuaauaacgaggaaggaggccauggggugaagggaugggcuuucgacgauggcaaugacguuuggauggggagaaccaucuccgagaaacugcggagcggauacgagacauuuaaggugaucggcggcuggucuaaacccaacuccaagcugcagauuaaucgccaggucaucguggauagagggaaccggagcggauauucuggcauuuucuccgucgaagggaaaagcugcaucaauagauguuuuuacguggagcucauucgcggacggaagcaggaaaccgagguuugguggacguccaacucuaucguggucuucugcggcacaagcgggaccuauggcaccggauccuggccugacggcgccgauauuaaucugaugcccaucuga

SEQ ID NO: 205132 - RNA, 1410 nt, Artificial Sequence
  derived and/or modified sequence opt5 from neuraminidase__InfluenzaA__AFH00453
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaguggucuaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauauuugggugacaagagagcccuauguuuccugugacccugauaagugcuaccaauucgcccuggggcagggaaccacacucaauaaccggcauucuaaugacaucgugcacgaucgcaccccguauagaacgcugcugaugaacgaacucggcguccccuuucaucuggggacaaaacagguguguaucgccuggagcuccagcucuugccacgacggaaaggcuuggcuucauguuugugugaccggccacgaugagaaugccacagcuuccuucauuuacgacggccggcuggucgauagcaucgggucuugguccaaaaagauucuccgcacccaggaaagcgagugcguguguaucaacggaaccugcacaguggucaugacggacggcucugccuccgggagagcggauaccaaaauucuguuuaucgaggaaggaaagaucguucacauuagcccucuuuccggcucugcccaacauguggaggaaugcagcuguuauccccgguacccuggggugcgcugcgucuguagagacaauuggaagggauccaaccggcccaucguggauauuaacguuaaagacuacagcaucgugucuuccuaugucugcagcggccuggugggcgacacaccgcgcaagaaugauucuagcuccucuagccacugucucaacccuaauaacgaggaagggggacauggcguuaaagggugggcuuucgacgauggaaaugacguguggaugggcagaaccauuuccgagaagcugcggagcggguacgagacauuuaaagucaucggaggcuggucuaagcccaacuccaaacugcagaucaaucgccaggugauugucgauagaggcaaccggagcggguauucuggaaucuucuccguggaaggcaagagcugcauuaauagauguuuuuacguugagcucauccgcgggcggaagcaggaaaccgaggugugguggacguccaacucuauugucguguucugcggaacaagcggcaccuaugggaccggcuccuggccugacggagccgauaucaaucugaugcccauuuga

SEQ ID NO: 205133 - RNA, 1410 nt, Artificial Sequence
  derived and/or modified sequence opt5 from neuraminidase__InfluenzaA__AFH00464
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaaaaaucggcauucuaacgauaccguucacgaccgcacgccguauagaacacugcugaugaaugaacucggggugcccuuucaucugggaaccaagcaggucuguaucgccuggagcuccagcucuugccacgauggcaaagccuggcuucauguguguguuacaggccacgacgagaacgcuaccgcuuccuucauuuacgggggacggcugguggauagcaucggcucuugguccaagaaaauucuccgcacccaggaaagcgagugcgucuguaucaaugggacaugcacgguggugaugaccgacggaucugccuccggcagagcggauacaaagauucuguuuaucgaggaagggaagaucguccacauuagcccucuuuccggaucugcccaacauguugaggaaugcagcuguuauccccgguacccuggcgugcgcugcguguguagagacaacuggaaaggcuccaaucggcccaucgucgauauuaacgugaaggacuacagcaucguuucuuccuaugugugcagcgggcuggucggagauaccccgcgcaaaaacgacucuagcuccucuagcuacugucucaauccuaacaaugaggaaggcgggcacggagugaagggcugggcuuucgacgaugggaacgacguuuggaugggaagaacaauuuccgagaaacugcggagcggcuaugagaccuuuaaggugaucggcggguggucuaaacccaauuccaagcugcagaucaaccgccaggucauuguggauagaggaaaucggagcggcuacucugggaucuucuccgucgaaggaaagagcugcauuaacagauguuuuuauguggagcucauccgcggccggaaacaggaaacggagguuugguggacauccaauucuauuguggucuucugcgggaccagcggcaccuacggaacaggcuccuggccugacggggccgauaucaaccugaugcccauuuga

SEQ ID NO: 205134 - RNA, 1410 nt, Artificial Sequence
  derived and/or modified sequence opt5 from neuraminidase__InfluenzaA__AFH00475
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccuguaauccugacaagugcuaccaauucgcccuggggcagggaaccacacucaacaaucggcauucuaacgauaccguucacgaccgcacgccguauagaacacugcugaugaaugaacucggcgugcccuuucaucuggggaccaaacaggucuguaucgccuggagcuccagcucuugccacgauggaaaggcuuggcuucauguguguguuacaggccacgacgagaacgccaccgcuuccuucauuuacgauggccggcugguggacagcaucgggucuugguccaaaaagauucuccgcacccaggaaagcgagugcgucuguaucaauggaacaugcacgguggugaugaccgauggcucugccuccgggagagcggacacaaaaauucuguuuaucgaggaaggaaagaucguccacauuagcccucuuuccggcucugcccaacauguugaggaaugcagcuguuauccccgguacccuggggugcgcugcguguguagagauaacuggaagggauccaaccggcccaucgucgacauuaaugugaaagauuacagcaucguuucuuccuaugugugcagcggccuggucggcgacaccccgcgcaagaacgacucuagcuccucuagccacugucucaauccuaacaaugaggaagggggacauggcgugaaagggugggcuuucgaugacggaaacgauguuuggaugggcagaacaauuuccgagaagcugcggagcggguacgagaccuuuaaagugaucgaaggauggucuaagcccaauuccaaacugcagaucaaccgccaggucauuguggacagaggcaaucggagcggcuauucugggaucuucuccgucgagggaaagagcugcauuaacagauguuuuuacguggaacucauccgcggccggaagcaggagacggaaguuugguggacauccaauucuauuguggucuucugcgggaccagcggaaccuauggcacaggguccuggccugauggcgccgacaucaaccugaugcccauuuga

SEQ ID NO: 205135 - RNA, 1410 nt, Artificial Sequence
  derived and/or modified sequence opt5 from neuraminidase__InfluenzaA__AFH00486
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuucugggcuccgcccaacauguugaggaaugcucuuguuauccccgguacccuggggugcgcugcguguguagagacaauuggaagggaagcaaccggcccaucgucgauauuaacgugaaagacuacuccaucguuagcucuuaugugugcuccggccucgucggcgacaccccgcgcaagaaugauagcucuagcuccucucacugucugaacccuaauaacgaggaagggggacauggcgugaaagggugggcuuucgacgauggaaaugacguuuggaugggcagaacaauuagcgagaagcugcgguccggguacgagaccuuuaaagugaucgaaggauggagcaagcccaacucuaaacuccagaucaaucgccaggucauuguggauagaggcaaccgguccggcuauagcgggaucuucucugucgagggaaaguccugcauuaauagauguuuuuacguggaacugauccgcggccggaagcaggagacggaaguuugguggacaagcaacuccauuguggucuucugcgggaccucuggaaccuauggcacagggagcuggccugacggcgccgauaucaaucuuaugcccauuuga

SEQ ID NO: 205136 - RNA, 1410 nt, Artificial Sequence
  derived and/or modified sequence opt5 from neuraminidase__InfluenzaA__AFH00497
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucaagaaagagauuuguccuaagcuggccgaauaccggaauuggagcaaaccccagugcaagaucaccggguucgcgccuuuuuccaaggacaacucuauucgccuuagcgcuggaggcgauaucugggucacaagagagcccuauguguccugugacccugggaaaugcuaccaauucgcccugggacagggcaccacacucaauaaccggcauucuaaugauaccguucacgaccgcacgccguauagaacacugcugaugaacgagcucggggugcccuuucaucugggaaccaagcaggucuguaucgccuggagcuccagcucuugccacgauggcaaggcuuggcuucauguguguguuacaggccacgacgaaaaugccaccgcuuccuucauuuacgaugggcggcugguggacagcaucggaucuugguccaaaaacauucuccgcacccaggagagcgaaugcgucuguaucaauggcacaugcacgguggugaugaccgaugggucugccuccgagagagcggacacaaaaauucuguuuaucgaggaaggaaagaucguccacauuagcccucuuuccggcucugcccaacauguugaggaaugcagcuguuauccccgguacccuggggugcgcugcguguguagagauaacuggaagggauccaaccggcccaucgucgacauuaaugugaaagauuacagcaucguuucuuccuaugugugcagcggccuggucggcgacaccccgcgcaagaacgacucuagcuccucuagcuacuguuggaauccuaacaaugagaaagggggacacggcgugaaggggugggcuuucgaugacggaaacgauguuuggaugggcagaacaauuuccgaggaacuccggagcggguaugagaccuuuaaagugaucggaggcuggucuaagcccaauuccaaacugcagaucaaccgccaggucauuguggacagaggcaaucggagcggguacucuggaaucuucuccgucgaaggcaagagcugcauuaacagauguuuuuauguggagcugauccgcgggcggaagcaggaaacggagguuugguggacauccaauucuauuguggucuucugcggaaccagcggcaccuacgggacaggcuccuggccugauggagccgacaucaaccucaugcccauuuga

SEQ ID NO: 205137 - RNA, 1410 nt, Artificial Sequence
  derived and/or modified sequence opt5 from neuraminidase__InfluenzaA__AFH00508
augaaccccaaucagaagaucauuaccaucggcagcgugucccugacaauugccacgaucugcuuccucaugcaaauugcuauccuggucaucaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugggaagugcuaccaauucgcccugggacagggcacaacccucaauaaccggcauucuaaugauacaguucacgaccgcaccccguauagaacgcugcugaugaacgaacucggggugcccuuucaucugggaacaaaacaggucuguauugccuggagcuccagcucuugccacgauggcaaggcuuggcuucauguguguguuaccggccacaaugagaacgccacagcuuccuucaucuacgacgggcggcugguggauagcauuggaucuugguccaaaaauauccuccgcacccaggaaagcgagugcgucuguauuaacggaaccugcacaguggugaugacggacgggucugccuccggcagagcggauaccaagauccuguuuaucgaggaaggcaaaauuguccacaucagcccucuuuccgggucugcccaacauguugaggaaugcagcuguuauccccgguacccuggagugcgcugcguguguagagacaacuggaagggcuccaaucggcccauugucgauaucaacgugaaggacuacagcauuguuucuuccuaugugugcagcggccuggucggggauacaccgcgcaaaaaugacucuagcuccucuagccacugucucaacccuaauaacgaggaaggaggccauggggugaagggaugggcuuucgacgauggcaaugacguuuggauggggagaaccaucuccgagaaacugcggagcggauacgagacauuucgcgugaucggcggcuggucuaagcccaacuccaaacugcagauuaauagacaggucaucguggaucgggggaacagaagcggauauucuggcauuuucuccgucgaaggaaagagcugcaucaaucgcuguuuuuacguggagcucauucgggggagaaaacaggaaaccgagguuugguggacguccaacucuaucguggucuucugcggcacaagcgggaccuauggcaccggauccuggccugacggcgccgauauuaaucugaugcccaucuga

SEQ ID NO: 205138 - RNA, 1410 nt, Artificial Sequence
  derived and/or modified sequence opt5 from neuraminidase__InfluenzaA__AFH00519
augaaccccaaucagaagaucauuaccaucggcagcgugucccugacaauugccacgaugugcuuccucaugcaaaucgcuauucuggucaccacaguuacccuucacuuuaaacaguacgaguguaacucuccuccgaauaaccaggugaugcugugcgaacccacaaucaucgagagaaauauuaccgaaaucguguaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauauuugggucacaagagagcccuauguguccugugacccugggaagugcuaccaauucgcccugggacagggcaccacacucaauaacgggcauucuaaugauaccguucacgaccggacgccguaucgcacacugcugaugaacgaacucggagugcccuuucaucugggcaccaaacaggucuguaucgccuggagcuccagcucuugccacgauggcaaggcuuggcuucauguguguguuacagggcacgacgagaaugccaccgcuuccuucaucuacgauggaagacugguggacagcauuggcucuugguccaaaaacauccuccggacccaggaaagcgagugcgucuguauuaaugggacaugcacgguggugaugaccgauggaucugccuccggccgcgcggacacaaagauccuguuuauugaggaagggaaaaucguccacaucagcccucuuuccggaucugcccaacauguugaggaaugcagcuguuaucccagauacccuggcgugcggugcgugugucgcgauaacuggaagggcuccaacagacccauugucgacaucaaugugaaggauuacagcauuguuucuuccuaugugugcagcgggcuggucggagacaccccgcggaaaaacgacucuagcuccucuagccacugucucaauccuaacaaugaggaaggcgggcauggagugaagggcugggcuuucgaugacgggaacgauguuuggaugggacgcacaaucuccgagaaacugagaagcggcuacgagaccuuuaaggugauuggcggguggucuaaacccaauuccaagcugcagaucaaccggcaggucaucguggaccgcggaaauagaagcggcuauucugggauuuucuccgucgaaggaaaaagcugcaucaaccgguguuuuuacguggagcucauuagaggccgcaagcaggaaacggagguuugguggacauccaauucuaucguggucuucugcgggaccagcggcaccuauggaacaggcuccuggccugauggggccgacauuaaccugaugcccaucuga

SEQ ID NO: 205139 - RNA, 1410 nt, Artificial Sequence; identical to SEQ ID NO: 197597
  derived and/or modified sequence opt5 from neuraminidase__InfluenzaA__AFH00530

SEQ ID NO: 205140 - RNA, 1410 nt, Artificial Sequence; identical to SEQ ID NO: 197597
  derived and/or modified sequence opt5 from neuraminidase__InfluenzaA__AFH00541

SEQ ID NO: 205141 - RNA, 1410 nt, Artificial Sequence
  derived and/or modified sequence opt5 from neuraminidase__InfluenzaA__AFH00552
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuuuaucgaggaaggaaagaucauucacaucagccaacuguccggcucuacccagcaugucgaggaaugcagcuguuauccccgguacccugggguucgcugcguguguagagacaauuggaagggauccaaccggcccauuguggauaucaacgucaaagacuacagcauugugucuuccuauguuugcagcggccucgugggcgacacaccucgcaagaaugauucuagcuccucuagccacugucugaaccccaauaacgaggaagggggacauggcgucaaagggugggccuucgacgauggaaaugacguguggaugggcagaaccaucuccgagaaguuucggagcggguacgagacguucaaaguuaucgaaggauggucuaagccgaacuccaaacugcagauuaaucgccaggugaucgucgauagagacaaccggagcggcuauucuggcauuuuuagcguggaggggaaguccugcaucaauagauguuucuacgucgaacucauucgcggacggaagcaagagacagaagugugguggaccuccaacucuaucguuguguuuugcggcaccagcgggacauauggaaccggcuccuggccugauggggcugacauuaaucugaugcccaucuga

SEQ ID NO: 205142 - RNA, 1410 nt, Artificial Sequence
  derived and/or modified sequence opt5 from neuraminidase__InfluenzaA__AFH00563
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaacggacgccguaucgcacacugcugaugaaugagcucggggugcccuuucaucugggaaccaagcaggucuguaucgccuggagcuccagcucuugccacgauggcaaagccuggcuucauguguguguuacaggcgacgaugaaaacgcuaccgcuuccuucauuuacaaugggagacugguggacagcaucggaucuugguccaagaaaauucuccggacccaggagagcgagugcgucuguaucaacggcacaugcacgguggugaugaccgaugggucugccuccggaaaggcggacacaaaaauucuguuuaucgaagagggcaagaucguccacaccagcccucuuuccgggucugcccaacacguugaagagugcagcuguuauccccgcuacccuggagugagaugcgugugucgggauaacuggaagggcuccaaucgccccauugucgacaucaacgugaaagauuacagcauuguuucuuccuaugugugcagcggccuggucggggacacaccgagaaagaaugacucuagcuccucuagccauugucucgauccuaacaaugaagagggaggccacggggugaaaggaugggcuuucgacgauggcaacgacguuuggauggggcggaccaucuccgagaagcugcgcagcggauacgaaacguuuaaagugauugagggcuggucuaagcccaauuccaaacugcagaucaacagacaggucaucguggaucggggcaaucgcagcggguauucuggaauuuucuccgucgaaggcaagagcugcaucaacagauguuuuuacguggagcucauucgggggagaaagcaggaaacagagguucuguggaccuccaauucuaucguggucuucugcggaaccagcggcacauaugggaccggcuccuggccugacggagccgauauuaaccuuaugcccaucuga

SEQ ID NO: 205143 - RNA, 1410 nt, Artificial Sequence
  derived and/or modified sequence opt5 from neuraminidase__InfluenzaA__AFH00574
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccaagaucauugagagaaauaucacagaaauuguguaucucaacaauaccacaaucgagaaagaaauuuguccuaagcuggccgaguaccggaacuggagcaaaccccagugcaauaucaccggguucgcgccuuuuuccaaggacaacucuauucgccuuagcgcuggaggcgauaucugggucacgagagagcccuauguguccugugacccugauaagugcuaccaauucgcccuggggcagggaaccacacucaauaacggccauucuaaugacaccguucacgaucggacaccguaucgcacccugcugaugaacgaacucggggugcccuuucaucugggaacgaaacaggucuguaucgccuggagcuccagcucuugccacgacggcaaggcuuggcuucauguguguguuacaggcgaugacgagaaugccaccgcuuccuucauuuacaacgggagacugguggauagcaucggaucuugguccaaaaagauucuccggacacaggaaagcgagugcgucuguaucaacgggaccugcaccguggugaugacagacggcucugccuccggaaaagcggauacgaagauucuguuuaucgaggaaggcaagaucguccacaccagccuucuguccgggucugcccaacacguugaggaaugcagcuguuauccucgcuaccccggagugagaugcgugugucgggacaauuggaaaggcuccaaccgcccuauugucgauaucaaugugaaggacuacagcauuguuucuuccuaugugugcagcggccucgucggggacacaccccggaaaaacgauucuagcuccucuagccauugucuggacccgaauaacgaggaaggaggccacggggugaagggaugggcuuucgaugacggcaaugauguuuggauggggagaaccaucuccgagaaacugcgcagcggauacgagacauuuaaggugauugaaggcuggucuaaaccuaacuccaagcuccagaucaauagacaggucaucguggaccggggcaaccgcagcggguauucuggaauuuucuccgucgagggcaagagcugcaucaauagauguuuuuacguggaacugauucgggggagaaaacaggagaccgaaguucuuuggacguccaacucuaucguggucuucugcggaacaagcggcaccuaugggaccggcuccuggcccgauggagccgacauuaaucugaugccuaucuga

SEQ ID NO: 205144 - RNA, 1410 nt, Artificial Sequence
  derived and/or modified sequence opt5 from neuraminidase__InfluenzaA__AFH00585
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucaagaaagagauuuguccuaagcuggccgaauaccggaauuggagcaaaccccagugcaacaucaccggguucgcgccuuuuuccaaggacaauucuauucgccuuagcgcuggaggcgauaucugggucacaagagagcccuauguguccugugacccugauaagugcuaccaauucgcccuggggcagggaaccacacucaacaaucggcauucuaacgacaaaguucacgaucgcaccccguauagaacgcugcugaugaaugagcucggcgugcccuuucaucuggggacaaagcaggucuguaucgccuggagcuccagcucuugccacgacggaaaagccuggcuucauguguguguuaccggcgaugacgaaaacgcuacagcuuccuucauuuacaauggccggcugguggauagcaucgggucuugguccaagaaaauucuccgcacccaggagagcgaaugcgucuguaucaacggaaccugcacaguggugaugacggacggcucugccuccgggaaggcggauaccaagauucuguuuaucaaagagggaaagaucguccacacaagcucccuuucuggcagcgcccaacacguugaggaaugcuccuguuauccuagauaccccggggugcggugcgugugucgcgacaacuggaaaggaagcaauagaccuauugucgauaucaacgugaaggacuacucuauuguuuccagcuaugugugcucuggccuggucggcgacacaccccggaaaaaugauagcuccucuagcucccauugucucgacccgaacaaugaggaagggggacacggcgugaaggggugggcuuucgaugacggaaacgauguuuggaugggccgcaccaucagcgagaaacugagaucuggguacgaaaccuuuaaggugauugagggaugguccaaggccaauagcaaacugcagaucaaccggcaggucaucguggaccgcggcaauagaucuggcuauuccgggauuuucagcgucgaguccaagucuugcaucaaccgguguuuuuacguggaacucauuagaggacgcaaacaggagacggaaguucuguggacaagcaauuccaucguggucuucugcggcaccucugggaccuauggaacaggcagcuggccugauggggcugacauuaaccuuaugcccaucuga

SEQ ID NO: 205145 - RNA, 1410 nt, Artificial Sequence; identical to SEQ ID NO: 197732
  derived and/or modified sequence opt5 from neuraminidase__InfluenzaA__AFH00596

SEQ ID NO: 205146 - RNA, 1410 nt, Artificial Sequence
  derived and/or modified sequence opt5 from neuraminidase__InfluenzaA__AFH00607
augaaccccaaucagaagaucauuaccaucggcuucguguuuuucacaauugccacgaucugcuuucugaugcaaauugcuauccucgucaccacaguuacccugcacuucaaacaguacgaguguaacccuccgcccaauaaccaggugaugcuuugcgaaccuacaaucauugagagaaauaucaccgaaauuguguaucugacaaacaccacgaucgagaaggaaauuugucccaaacucgccgaguaccggaauuggagcaagccucagugcaacaucaccggguuugcgcccuucuccaaagacaauucuauucgccugagcgcuggaggcgauaucugggucacaagagagccuuauguguccugugacccggauaagugcuaccaauuugcccuugggcagggaaccacacugaacaauggccauucuaacgacaccguucacgaucggacgcccuaucgcacacuccugaugaaugaacugggggugccuuuccaucucggaaccagacaggucuguaucgccuggagcuccucuagcugccacgacggcaaggcuuggcugcauguguguguuacaggcgaugacgagaacgccaccgcuuccuuuauuuacaaugggcggcuuguggauagcaucggaucuugguccaaaaagauucugcgcacccaggaaagcgagugcgucuguaucaacggcacaugcacgguggugaugaccgacgggucugccuccggaaaagcggauacaaagauucucuucaucgaggaaggcaaaaucguccacauuagcacccugucuggguccgcccaacacguugaggaaugcagcuguuaucccagauacccuggagugcggugcgugugucgcgacaacuggaagggcuccaauagacccaucgucgauauuaacgugaaggacuacucuaucguuagcuccuaugugugcagcggccuugucggggacacaccgcggaaaaaugauucuuuuuccagcucucauugucuggacccuaacaaugaggaaggaggccacggggugaagggaugggcuuucgaugacggcaacgauguuuggauggggcgcaccauuagcgagaaacucagauccggauacgagacguuuaaggugaucgaaggcuggucuaaacccaauagcaagcugcagacaaaccggcaggucaucguggagcgcggcaauagauccggguauagcggaauuuucucugucgaaggcaaauccugcaucaaccgguguuucuacguggagcugauuagagggcgcaaggaagagaccgagguuugguggaccagcaauucuaucguggucuuuugcggaacauccggcaccuaugggacaggcagcuggccugacggagccgauauuaaccucaugcccaucuga

SEQ ID NO: 205147 - RNA, 1410 nt, Artificial Sequence; identical to SEQ ID NO: 198953
  derived and/or modified sequence opt5 from neuraminidase__InfluenzaA__AFH00618

SEQ ID NO: 205148 - RNA, 1410 nt, Artificial Sequence
  derived and/or modified sequence opt5 from neuraminidase__InfluenzaA__AFH00629
augaaccccaaucagaagaucauuaccaucggcagcgugucccugacaauugccacgaucugcuuccucaugcaaauuaccauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggggauuuguccuaaacuggcugaauaccggaauuggagcaagccccagugcaacaucacaggauucgccccuuuuuccaaagacaauucuauucgccuuagcgcgggcggggauaucugggucaccagagagcccuauguguccugugacccugauaagugcuaccaauucgcucugggacagggcacaacccucaacaaugggcauucuaacgacacgguucacgaucggacaccguaucgcacccugcugaugaaugagcucggagugcccuuucaucugggcacaagacaggucuguaucgccuggagcuccagcucuugccacgacggcaaggccuggcuucauguguguguuaccggggaugacaaaaacgcuaccgccuccuucauuuacaauggacggcugguggauagcaucggcucuugguccaagaaaauucuccgcacacaggaaagcgagugcgucuguaucaacgggacgugcaccguggugaugacagacggaucugcuuccggcaaggccgauaccaaaauucuguuuaucgaagaggggaagaucauucacaucagcacacuucugggauccgcgcaacacgucgaggaaugcucuuguuauccuagauaccccggcguucggugcgugugucgcgacaacuggaagggcagcaauagaccuauuguggauaucaacgucaaagacuacuccauugugagcucuuauguuugcuccgggcucgugggagacacgccccggaagaaugauagcucuagcuccucucauugucuggacccgaacaaugaggaaggcgggcacggagucaaaggcugggccuucgaugacgggaacgauguguggaugggacgcaccaucagcgagaagcugagauccggcuacgaaacauuuaaaguuaucgagggcuggagcaagccuaauucuaaacuccagauuaaccgccaggugaucgucgagcgggggaauagauccggauauagcggcauuuucucuguggaagggaaguccugcaucaaccgguguuuuuacgucgagcugauuagaggacgcaaggaagagaccgaagugugguggaccagcaauuccaucguuguguucugcggcacaucugggaccuauggcacaggaagcuggcccgacggcgcugauauuaaccuuaugccuaucuga

SEQ ID NO: 205149 - RNA, 1410 nt, Artificial Sequence; identical to SEQ ID NO: 197351
  derived and/or modified sequence opt5 from neuraminidase__InfluenzaA__AFH00640

SEQ ID NO: 205150 - RNA, 1410 nt, Artificial Sequence; identical to SEQ ID NO: 199480
  derived and/or modified sequence opt5 from neuraminidase__InfluenzaA__AFH00651

SEQ ID NO: 205151 - RNA, 1410 nt, Artificial Sequence; identical to SEQ ID NO: 197351
  derived and/or modified sequence opt5 from neuraminidase__InfluenzaA__AFH00662

SEQ ID NO: 205152 - RNA, 1410 nt, Artificial Sequence
  derived and/or modified sequence opt5 from neuraminidase__InfluenzaA__AFH00673
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaccugcccuaaacucgcugaguaccggaacuggucuaagccccagugugacaucacaggguucgccccuuuuagcaaagauaauuccauucgccugucugcgggaggcgacaucugggugaccagagagcccuaugucagcugcgauccugacaaguguuaccaauucgcucuugggcagggaacaacccugaacaaugugcauuccaacgauacgguucacgaccggacaccguaucgcacccuccugaugaaugaacugggcgugcccuuucaucucgggacaaagcaggucugcaucgccuggucuagcuccagcugucacgauggaaaagccuggcugcaugugugcguuaccggcgacgauaagaacgcuaccgccucuuucauuuacaauggcagacuuguggacuccaucgucagcuggucuaaagagauucugcggacacaggaauccgagugugugugcaucaacgggacguguaccguggucaugacagauggaagcgcuuccggcaaggccgacaccaaaauucucuuuaucgaggaagggaagaucguucacacaucuacccugagcggauccgcgcaacacguggaggaaugcagcugcuauccucgcuaccccggcgugagaugugucugccgggauaauuggaaggggucuaaccgcccuauuguggacaucaacauuaaagacuacuccaucguuagcagauauguguguucuggacuugucggcgauacgccccggaagaaugacagcuccucuagcucccauugccuggauccgaacaaugaggaaggcgggcacggagugaaaggcugggccuucgacgaugggaacgacguuuggaugggacgcacaauuagcgugaagucuagauccggcuacgagaccuuuaaagucaucgagggguggagcaauccuaacucuaagcuccagaucaaucgccaggugauugucgaucggggaaacagauccggcuauagcggcaucuucuccguggaagggaaaucuuguauuaaucggugcuuuuacguugagcugaucagaggacgcaaggaagagaccgaagugcuguggacaagcaacuccauugucguguucuguggcaccucugggacauauggaacgggcagcuggcccgacggggcugauaucaaucucaugccuauuuga

SEQ ID NO: 205153 - RNA, 1410 nt, Artificial Sequence
  derived and/or modified sequence opt5 from neuraminidase__InfluenzaA__AFH00684
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaacgcacgccguauagaacacuccugaugaaugagcugggcgugcccuuucaccucgggaccaagcaggucugcauugccugguccucuagcuccugucaugauggaaaagccuggcugcacgugugcaucacaggcgacgauaagaacgcuaccgccagcuucauuuacaauggccggcuuguugacucuaucguguccuggagcaaagaaauucugcgcacccaggagucugagugugucugcaucaacgggacauguacgguggugaugaccgauggauccgcuagcggcaaggccgacacaaaaauccucuuuauugaagaggggaagaucguccauaccuccacacugucuggaagcgcgcaacacguugaagagugcuccugcuauccuagauaccccggcgugcggugugugugccgcgauaacuggaaggggagcaauagaccuauugucgacaucaacauuaaagaucacucuaucguguccagcuacguuuguucuggacuugugggcgacacgccccggaagaaugacagcuccucuagcucccauugccuggauccgaacaaugaagagggcgggcacggagucaaaggcugggccuucgacgaugggaacgacguguggaugggacgcaccaucagcgagaagucuagacucggcuaugaaacauuuaaaguuauugaggggugguccaauccuaagagcaaacugcagaucaaccgccaggugauugucgaucggggaaauagaucuggcuacuccggcaucuucagcguggaagggaaguccuguauuaaccggugcuuuuaugucgagcugaucagaggacgcaaggaagagaccgaggugcucuggaccucuaauagcauuguuguguucuguggcacauccgggaccuacggaacaggcucuuggcccgacggggcugauaucaaccugaugccuaucuga

SEQ ID NO: 205154 - RNA, 1410 nt, Artificial Sequence
  derived and/or modified sequence opt5 from neuraminidase__InfluenzaA__AFH00695
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaacgcacgccguauagaacacuccugaugaacgagcugggcgugcccuuucaccucgggaccaagcaggucugcauugccugguccucuagcuccugucaugacggaaaagccuggcugcacgugugcaucacaggcgaugacaagaaugcuaccgccagcuucauuuacaacggccggcuuguugauucuaucguguccuggagcaaagaaauucugcgcacccaggagucugagugugucugcaucaaugggacauguacgguggugaugaccgacggauccgcuagcggcaaggccgauacaaaaauccucuuuauugaagaggggaagaucguccauaccuccacacugucuggaagcgcgcaacacguugaagagugcuccugcuauccuagauaccccggcgugcggugugugugccgcgacaacuggaaggggagcaacagaccuauugucgauaucaauauuaaagaccacucuaucguguccagcuacguuuguucuggacuugugggcgacacgccccggaagaacgauagcuccucuagcucccauugccuggacccgaauaacgaagagggcgggcacggagucaaaggcugggccuucgaugacgggaaugauguguggaugggacgcaccaucagcgagaagucuagacucggcuaugaaacauuuaaaguuauugaggggugguccaacccuaagagcaaacugcagaucaaucgccaggugauugucgaccggggaaacagaucuggcuacuccggcaucuucagcguggaagggaaguccuguauuaaucggugcuuuuaugucgagcugaucagaggacgcaaggaagagaccgaggugcucuggaccucuaacagcauuguuguguucuguggcacauccgggaccuacggaacaggcucuuggcccgauggggcugacaucaaucugaugccuaucuga

SEQ ID NO: 205155 - RNA, 1410 nt, Artificial Sequence
  derived and/or modified sequence opt5 from neuraminidase__InfluenzaA__AFH00706
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaugaaagaucacucuaucguuuccagcuacguguguucuggacuugucggcgacacgccccggaagaacgacagcuccucuagcucccauugcuucgauccgaauaacgaggaaggcgggcacggagugaaaggcugggccuuugacgaugggaaugacguuuggaugggacgcaccauuagcgagaagucuagacugggcuaugagacauucaaagugaucgaagggugguccaacccuaagagcaaacuccagaucaaucggcaggucauuguggaucgcggagacagaucuggcuacuccggcaucuuuagcgucgaggggaaguccuguauuaaccggugcuucuauguggaacugaucagaggaucuaaggaggaaaccgagguucuguggaccagcaauuccauuguggucuucuguggcacaucugggaccuacggaacaggcagcuggcccgauggggcugacaucaaccucaugccuauuuga

SEQ ID NO: 205156 - RNA, 1410 nt, Artificial Sequence
  derived and/or modified sequence opt5 from neuraminidase__InfluenzaA__AFH00728
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccugaacaauaaacauagcaacgauacaauucacgaccggacccccuaucgcacgcuccugaugaaugaacugggggugccuuuucaucucggaacaagacaggucuguaucgccugguccuccucuuccugccacgauggcaaggccuggcugcauguguguguuaccggccacgacaaaaacgcuacagccagcuucauuuacaaugggcggcuuguggauucuaucggauccuggagcaagaacauucugcgcacccaggagucugaaugcgucuguaucaaugggaccugcacaguggugaugacggacggcuccgcuagcgagagagccgauaccaaaauccucuuuauugaggaaggaaagaucguccacauuagcccccugucuggcagcgcgcaacauguugaggaaugcuccuguuauccucgguaccccggggugcgcugcguguguagagacaacuggaagggaagcaaccggccgaucgucgauauuaaugugaaagacuacucuaucguuuccagcuaugugugcucuggccuugucggcgauacaccucgcaagaacgacagaagcuccucuagcuacugucggaaucccaacaaugagaaagggaaccacggagugaagggcugggccuucgacgaugggaaugacguuuggaugggacgcaccaucggcgaggaacugagauccggguaugagacauuuaaagugauuggaggcuggagcaccccuaacucuaagcuccagaucaaucggcaggucauuguggauuccgacaacagaagcggcuacucugggaucuucuccgucgaaggaaaaagcugcauuaaucgcuguuuuuauguggagcugauccggggcagagaacaggagacgcgcguucuguggacauccaacucuauuguggucuucugcgggaccagcggaaccuacggcacaggguccuggcccgauggcgcugacaucaaucucaugcccaucuga

SEQ ID NO: 205157 - RNA, 1410 nt, Artificial Sequence
  derived and/or modified sequence opt5 from neuraminidase__InfluenzaA__AFH00739
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucauuuacgaugggcggcuugucgacucuaucggauccuggagcaagaauauucugcgcacccaggagucugaaugcguguguaucaacggcacaugcacgguggucaugaccgauggguccgcuagcgagagagccgacacaaaaauucucuuuaucgaggaaggaaagaucguucacauuagcccccugucuggcagcgcgcaacauguggaggaaugcuccuguuauccucgguaccccggggugcgcugcgucuguagagauaauuggaagggaagcaaccggccgaucguggacauuaacguuaaagauuacucuaucguguccagcuaugucugcucuggccuugugggcgacaccccucgcaagaaugacagaagcuccucuagcuacugucggaaccccaauaacgagaaagggucccacggaguuaagggcugggccuucgaugacgggaaugauguguggaugggacgcacaauuggcgaggaacugagaagcggguaugagaccuuuaaagucaucggaggcuggucuacgccuaacuccaagcuccagaucaauagacaggugauugucgacagcggcaaccggucuggguacuccggaaucuucagcguggaaggcaaauccugcauuaaucgcuguuuuuauguugagcugauccgggggagaggacaggaaacacgcgugugguggaccucuaacagcauugucguguucugcggcaccuccgggacauacggcaccggaucuuggcccgauggcgcugacaucaaucugaugcccauuuga

SEQ ID NO: 205158 - RNA, 1410 nt, Artificial Sequence
  derived and/or modified sequence opt5 from neuraminidase__InfluenzaA__AFH00750
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucauuuacgaugggcggcuugucgacucuaucggauccuggagcaagaauauucugcgcacccaggagucugaaugcguguguaucaacggcacaugcacgguggucaugaccgauggguccgcuagcgagagagccuauacaaaaauucucuuuaucaaggagggaaagaucguucacauuagcccccugucuggcagcgcgcaacauguggaagagugcuccuguuacccucgguaccccggggugcgcugcgucuguagagacaauuggaaaggaagcaaccggccgaucguggauauuaacguuaaggacuauucuaucguguccagcuacgucugcucuggccuugugggcgauaccccucgcaaaaaugacagaagcuccucuagcuauugucggaaccccaauaacgaaaaggggucccacggaguuaaaggcugggccuucgacgaugggaaugacguguggaugggacgcacaauuggcgaggaacugagaagcggguacgagaccuuuaaggucaucggaggcuggucuacgccuaacuccaaacuccagaucaauagacaggugauugucgagagcggcaaccggucuggguauuccggaaucuucagcguggaaggcaaguccugcauuaaucgcuguuuuuacguugagcugauccgggggagagaacaggagacacgcgugugguggaccucuaacagcauugucguguucugcggaaccuccggcacauaugggaccggcucuuggcccgauggagcugacaucaaucugaugcccauuuga

SEQ ID NO: 205159 - RNA, 1410 nt, Artificial Sequence
  derived and/or modified sequence opt5 from neuraminidase__InfluenzaA__AFH00761
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcccugcgaaccuacaaucauugagagaaauaucaccgaaauuguguaucugacaaacaccacgaucgagaaggaaauuugucccaaacucgucgaguaccggaauuggagcaagccucagugcaaaaucaccggguucgcccccuuuuccaaggacaacucuauucgccugagcgcgggaggcgauaucugggugacaagagagccuuauguuuccugugacccggggaagugcuaccaauucgcucuuggacagggcaccacacugaauaaccggcauucuaaugauaccgugcacgaccgcacgcccuauagaacacuccugaugaacgaacugggggucccuuuucaucucggaaccaaacagguguguaucgccuggagcuccagcucuugccacgauggcaaggccuggcugcauguuugugugacaggccacgacgagaaugcuaccgccuccuucauuuacgaugggcggcuugucgacagcaucggaucuugguccaaaaacauucugcgcacccaggaaagcgagugcguguguaucaauggcacaugcacgguggucaugaccgaugggucugcuuccgagagagccgacacaaagauucucuuuaucgaagagggaaaaaucguucacauuagcccccuguccggcucugcgcaacauguggaagagugcagcuguuauccucgguaccccggggugcgcugcgucuguagagauaacuggaagggauccaaccggccgaucguggacauuaauguuaaggauuacagcaucgugucuuccuaugucugcagcggccuugugggcgacaccccucgcaaaaacgacucuagcuccucuagcuacuguagaaaucccaacaaugaaaaggggucccacggaguuaaaggcugggccuucgaugacggggaugacguguggaugggacggacaauuggcgaggagcugcgcagcggguaugaaaccuuuaaggucaucggaggcuggucuacgccuaacuccaaacuccagaucaauagacaggugauugucgaucggggcaacagaagcggguacucuggaaucuucuccguggagggcaagagcugcauuaaucgcuguuuuuauguugaacugauccgggggagaaaacaggagacaaaggugugguggaccuccaacucuauugucguguucugcggaaccagcggcacauacgggaccggcuccuggcccgacggagcugauaucaaucugaugcccauuuga

SEQ ID NO: 205160 - RNA, 1410 nt, Artificial Sequence
  derived and/or modified sequence opt5 from neuraminidase__InfluenzaA__AFH00783
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcggggaaccacacucaauaaccgccauucuaaugacaccguucacgauagaacgccguaucggacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccgccugguggauagcaucgggucuugguccaaaaagauucucagaacccaggaaagcgagugcgucuguaucaacggaacaugcacgguggugaugaccgacggcucugccuccgggcgggcggauacaaaaauucuguuuaucgaggaaggaaagaucguccacauuagcccucuuuccggcucugcccagcauguugaggaaugcagcuguuauccccgcuacuccggggugagaugcgugugucgggacaauuggaagggaagcaaccgcccuaucgucgauauuaacgugaaagacuacucuaucguuuccagcuaugugugcucuggccuggucggcgacacccccagaaagaaugauagcuccucuagcucccacugucucaacccgaauaacgaggaagggggacauggcgugaaagggugggcuuucgacgauggaaaugacguuuggaugggccggacaauuagcgagaaguuucgcucuggguacgagaccuucaaagugaucggaggcugguccaagccuaacagcaaacugcaaaucaauagacaggucauuguggaucggggcaacagaucuggguauuccggaaucuuuagcgucgaaggcaaguccugcauuaaucgcuguuucuacguggagcugauccgggggagaaagcaggaaacggagguuugguggacaucuaacagcauuguggucuuuugcggaaccuccggcaccuaugggacaggcucuuggcccgacggagccgauaucaaucucaugccuauuuga

SEQ ID NO: 205161 - RNA, 1410 nt, Artificial Sequence
  derived and/or modified sequence opt5 from neuraminidase__InfluenzaA__AFH00794
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuugcugccggaggcgauaucugggucacaagagagcccuaugugagcugugacccugauaagugcuaccaauucgcccuggggcagggaaccacacucaauaaccggcauuccaaugacaccguucacgaucgcacgccguauagaacacugcugaugaacgaacucggcgugcccuuucaucuggggaccaaacaggucuguaucgcuuggucuagcuccagcugccacgacggaaaggccuggcuucauguguguguuacaggccacgaugagaaugcuaccgccucuuucauuuacgacggccggcugguggauuccaucgggagcuggucuaaaaagauucuccgcacccaggaauccgagugcgucuguaucaacggaacaugcacgguggugaugaccgacggcagcgcgucugagagagccgauacaaaaauucuguuuaucgaagaggggaagaucguccacauuucccaacuuagcggauccgcucagcauguugaagagugcucuuguuauccucgguaccccggcgugcgcugcguguguagagacaauuggaaggggagcaaccggccuaucgucgauauuaacgugaaagacuacuccaucguuagcucuuaugugugcuccggacuggucggcgacacaccccgcaagaaugauagcucuagcuccucucacugucucaacccgaauaacgaagagggcgggcauggagugaaaggcugggccuucgacgauggggacgauguuuggaugggaagaaccauuagcgagaagcugcgguccggcuacgaaaccuuuaaagugaucgagggguggagcaagccuaauucuaaacugcagacgaaccgccaggucaucguggacagaggaaaucgguccggcuauagcggcauuuucucugucgaagggaaguccugcaucaacagauguuuuuacguggagcucauucgcggacggaagcaagaaacagagguuugguggaccagcaauuccaucguggucuucugcggcaccucugggacauauggaaccggcagcuggcccgauggggcugacauuaaccugaugccuaucuga

SEQ ID NO: 205162 - RNA, 1410 nt, Artificial Sequence; identical to SEQ ID NO: 198512
  derived and/or modified sequence opt5 from neuraminidase__InfluenzaA__AFH00805

SEQ ID NO: 205163 - RNA, 1410 nt, Artificial Sequence; identical to SEQ ID NO: 202542
  derived and/or modified sequence opt5 from neuraminidase__InfluenzaA__AFH00816

SEQ ID NO: 205164 - RNA, 1410 nt, Artificial Sequence
  derived and/or modified sequence opt5 from neuraminidase__InfluenzaA__AFH00827
augaaccccaaucagaagaucauuaccaucggcagcgugucccugacaauuucuacgaccugcuucuuuaugcaaaucgccauucucaucacaaccgucacacugcacuucaaacaguacgaguuuaacagcccuccgaauaaccagguuaugcuuugugaacccaccaucauugagagaaauaugacagaaaucguguaucugaccaacacgaccauugagaaggaaaucugcccuaaacccgcugaguaccggaauugguccaagccucagugugacauuacaggguucgcccccuuuucuaaagauaacagcauccgccucuccgcgggaggcgacauuugggugaccagagagccuuaugucucuugcgauccggacaaguguuaccaauucgcucuggggcagggaacaacccuuaauaacgugcauagcaauaacacgguucgggaucgcacacccuauagaacccugcucaugaaugaacugggcgugccuuuucaccuggggacaaagcaggucugcaucgccugguccucuagcuccugucaugacggaaaagccuggcuccacgugugcaucaccggcgaugacaagaacgcuaccgccagcuucauuuacaauggccggcugguugauucuguggucuccuggagcaaagagauccuucgcacacaggaaucugagugugugugcauuaacgggacguguaccguggucaugacagacggauccgcuagcggcaaggccgauaccaaaauccuguuuauugaggaagggaagaucguucauacauccacccucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacacgccgcggaagaaugauagcuccucuagcucccauugccuugacccuaacaaugaggaaggcgggcacggagugaaaggcugggccuucgaugacgggaacgauguuuggaugggacgcacaaucaaugagaccagcagacugggcuaugagaccuuuaaggugauugaaggguggucuaaccccaaauccaagcuccagaucaaucggcaggucaucguggaccgcggagauagaagcggcuacucuggcauuuucuccgucgaggggaaaagcuguaucaaccggugcuuuuauguggaacugauuagaggacgcaaggaggaaacagagguucuguggaccuccaauucuaucguggucuucuguggcacaagcgggacguacggaaccggcuccuggccugacggggcugaucucaaccugaugccccuuuga

SEQ ID NO: 205165 - RNA, 1410 nt, Artificial Sequence; identical to SEQ ID NO: 198953
  derived and/or modified sequence opt5 from neuraminidase__InfluenzaA__AFH01410

SEQ ID NO: 205166 - RNA, 1410 nt, Artificial Sequence
  derived and/or modified sequence opt5 from neuraminidase__InfluenzaA__AFH34942
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccaagauuaucgagagaaauauuacagaaaucguguaucugaccaacacaaccauugagaaagaaaucugcccuaagcccgcugaguaccggaauugguccaaaccucagugugacauuacgggguucgcccccuuuucuaaggauaacagcauccgccucuccgcgggaggcgacaucugggugaccagagagccuuaugucucuugcgauccggacaaguguuaccaauucgcucuggggcagggaacaacccuuaauaacgugcauagcaauaacacaguucggaaucgcacccccuauagaacgcugcucaugaacgaacugggcgugccuuuucaccuggggacaaaacaggucugcauugccugguccagcagcuccugucaugauggaaaggccuggcuccacgugugcaucaccggcgacgauaaaaaugcuacagccagcuucauuuacaacggcaagcugguugacucuguggucuccuggagcaaagagauccuucggacccaggaaucugagugugugugcauuaacgggaccuguacaguggucaugacggauggauccgcuagcggcaaggccgacaccaagauccuguuuaucgaggaagggaaaauuguucauacauccacccucucuggaagcgcgcaacacguggaggaaugcuccugcuauccccgcuacccuggcgugagaugugucugccgggauaauuggaaggggagcaaccgccccaucguggacauuaauaucaaagaucacucuauuguuuccagcuacguguguucuggacuggucggcgacacaccgagaaagaacgacagcuccucuagcucccauugccuugauccuaauaacgaggaaggcgggcacggagugaaaggcugggccuucgacgaugggaaugacguuuggaugggacggaccaucaacgagacgagccgccugggcuaugagacauuuaaggugaucgaaggguggucuaaucccaaauccaagcuccagauuaacagacaggucaucguggaucggggagaccgcagcggcuacucuggcauuuucuccgucgaggggaagucuuguaucaauagaugcuuuuauguggaacugauucggggaagaaaagaggaaaccgagguucuguggaccuccaacucuaucguggucuucuguggcacaagcgggaccuacggaacaggcuccuggccugauggggcugaccucaaucugaugcccauuuga

SEQ ID NO: 205167 - RNA, 1410 nt, Artificial Sequence
  derived and/or modified sequence opt5 from neuraminidase__InfluenzaA__AFH34956
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucggggccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaaugagguucuguggaccuccaacucuaucguggucuucugugggacaagcggaaccuacggcacaggguccuggccugauggcgcugaccucaaucugaugcccauuuga

SEQ ID NO: 205168 - RNA, 1410 nt, Artificial Sequence
  derived and/or modified sequence opt5 from neuraminidase__InfluenzaA__AFH34963
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacauuguucgggaucgcacccccuauagaacgcugcucaugaaugaacugggcgugccuuuucaccuggggacaaagcaggucugcaucgccugguccucuagcuccugucaugacggaaaagccuggcuccacgugugcauuaccggcgaugacaagaacgcuacagccagcuucaucuacaauggccggcugguugauucuguggucuccuggagcaaagagauucuucgcacccaggaaucugagugugugugcaucaacgggaccuguacaguggucaugacggacggauccgcuagcggcaaggccgauaccaaaauccuguuuauugaggaagggaagaucguucauacauccacccucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacacaccgcggaagaaugauagcuccucuagcucccauugccuugacccuaacaaugaggaaggcgggcacggagugaaaggcugggccuucgaugacgggaacgauguuuggaugggacgcaccaucaaugagacgagcagacugggcuaugagacauuuaaggugauugaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaaaugagguucuguggaccuccaacucuauuguggucuucuguggcaccagcgggacauacggaaccggcuccuggccugacggggcugaucucaaucugaugcccaucuga

SEQ ID NO: 205169 - RNA, 1410 nt, Artificial Sequence
  derived and/or modified sequence opt5 from neuraminidase__InfluenzaA__AFH34970
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuaugaacccacaauuaucgagagaaauauuaccgaaaucguguaccugacaaacaccacgauugagaaggaaaucuguccuaaacccgcugaguaucggaauugguccaagccucagugcgacauuaccggguucgcccccuuuucuaaagauaacagcauccgccucuccgcgggaggcgacaucugggugacaagagagccuuacgucucuugugauccggacaagugcuaucaauucgcucuggggcagggaaccacacuuaauaacgugcauagcaauaacaccguucgggaucgcacgcccuacagaacacugcucaugaaugaacugggcgugccuuuucaccuggggaccaagcaggucuguauugccugguccucuagcuccugccaugacggaaaagccuggcuccacguguguaucacaggcgaugacaagaacgcuaccgccagcuucauuuauaauggccggcugguugauucuguggucuccuggagcaaagagauccuucgcacccaggaaucugagugcguguguauuaacgggacaugcacgguggucaugaccgacggauccgcuagcggcaaggccgauacaaaaauccuguuuaucgaggaagggaagauuguucauaccuccacacucucuggaagcgcgcaacacguggaggaauguuccugcuaccccagauacccuggcgugcggugcgucugucgcgacaacuggaaggggagcaauagacccaucguggauauuaacaucaaagaccacucuauuguuuccagcuaugugugcucuggacuggucggcgacaccccgcggaagaaugauagcuccucuagcucccauugucuugacccuaacaaugaggaaggcgggcacggagugaaaggcugggccuucgaugacgggaacgauguuuggaugggacgcacgaucaaugagacaagcagacugggcuacgagaccuuuaaggugaucgaaggguggucuaaccccaaauccaagcuccagauuaaucggcaggucaucguggaccgcggagauagaagcggcuauucuggcauuuucuccgucgaggggaaaagcugcaucaaccgguguuuuuacguggaacugauuagaggacgcaaggaggaaaaugagguucuguggaccuccaacucuaucguggucuucugcggcacaagcgggaccuauggaacaggcuccuggccugacggggcugaucucaaucugaugcccauuuga

SEQ ID NO: 205170 - RNA, 1410 nt, Artificial Sequence
  derived and/or modified sequence opt5 from neuraminidase__InfluenzaA__AFH34977
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaccgagguucuguggacauccaauucuaucguggucuucugugggaccagcggaacauacggcacgggguccuggccugauggcgcugaccucaaccugaugcccauuuga

SEQ ID NO: 205171 - RNA, 1410 nt, Artificial Sequence
  derived and/or modified sequence opt5 from neuraminidase__InfluenzaA__AFH74468
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugaauaacgugcauagcaauaacacgguucgggaucgcacaccguacagaacccuccugaugaaugaacugggcgugcccuuucaccucgggacaaagcaggucuguaucgccugguccucuagcuccugccaugacggaaaagccuggcugcacguguguauuaccggcgaugacaagaacgcuaccgccagcuucaucuauaauggccggcuuguugauucuguggucuccuggagcaaagagauucugcgcacacaggaaucugagugcguguguaucaacgggacgugcaccguggucaugacagacggauccgcuagcggcaaggccgauaccaaaauucucuuuaucgaggaagggagaaucguucauacauccacccugucuggaagcgcgcaacacguggaggaaugcuccuguuacccucgguaucccggcgugcgcugcgucuguagagacaacuggaaggggagcaaucggccuauuguggauaucaacauuaaggaccacucuaucguuuccagcuacgugugcucuggacuugucggcgacacgccccgcaaaaaugauagcuccucuagcucccauugucuggacccgaacaaugaggaaggcgauaacggggugaagggaugggccuucgacgauggcaaugacguuuggauggggagaacaauuagcgagaaaucucggcucggauacgagaccuuuaaggugaucgaaggcugguccaacccuaaaagcaagcugcagaucaaucgccaggucauuguggauagagggaaccggucuggauauuccggcaucuucagcgucgagggcaaauccugcauuaauagauguuuuuacguggaacugauccgcgggcggaaggaggaaaccgagguucucuggacaucuaacagcauuguggucuucugcggaaccuccggcacauaugggacgggaucuuggcccgacggcgcugauaucaaucugaugccuauuuga

SEQ ID NO: 205172 - RNA, 1410 nt, Artificial Sequence; identical to SEQ ID NO: 201675
  derived and/or modified sequence opt5 from neuraminidase__InfluenzaA__AFH74469

SEQ ID NO: 205173 - RNA, 1410 nt, Artificial Sequence; identical to SEQ ID NO: 199623
  derived and/or modified sequence opt5 from neuraminidase__InfluenzaA__AFH74480

SEQ ID NO: 205174 - RNA, 1410 nt, Artificial Sequence; identical to SEQ ID NO: 199623
  derived and/or modified sequence opt5 from neuraminidase__InfluenzaA__AFH74491

SEQ ID NO: 205175 - RNA, 1410 nt, Artificial Sequence; identical to SEQ ID NO: 204666
  derived and/or modified sequence opt5 from neuraminidase__InfluenzaA__AFH74502

SEQ ID NO: 205176 - RNA, 1410 nt, Artificial Sequence
  derived and/or modified sequence opt5 from neuraminidase__InfluenzaA__AFH74513
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaccugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuguggucuccuggagcaaagagauucugcgcacacaggaaucugagugugugugcaucaacgggacguguaccguggucaugacagacggauccgcuagcggcaaggccgauaccaaaauucucuuuaucgaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcacaauuagcgagaagucuagacucggcuaugagaccuuuaaagugaucgaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaaccgagguucucuggacaucuaauagcauuguggucuucuguggcaccuccgggacauacggaacgggcucuuggcccgauggggcugacaucaaccugaugccuguguga

SEQ ID NO: 205177 - RNA, 1410 nt, Artificial Sequence
  derived and/or modified sequence opt5 from neuraminidase__InfluenzaA__AFH74524
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacaauuaauaacgugcauagcaauaacaccguucgggaucgcacgccguauagaacacugcucaugaaugaacugggcgugcccuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauccuguuuauugaggaagggaagaucguucauaccuccacacucucuggaagcgcgcaacacguggaggaaugcuccugcuauccuagauaccccggcgugcggugugucugccgcgacaacuggaaggggagcaauagaccuauuguggauaucaacaugaaagaccacucuauuguuuccagcuacguguguucuggacuggucggcgacacgccccggaagaaugauagcuccucuagcucccauugccuugacccgaacaaugaggaaggcgggcacggagugaaaggcugggccuucgaugacgggaacgauguuuggaugggacgcaccaucagcgagaagucuagacugggcuaugagacauuuaaagugaucgaagggugguccaauccuaagagcaaacuccagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucuguggaccucuaauagcguggucguguucuguggcacauccgggaccuacggaacaggcucuuggcccgauggggcugacaucaaccucaugccuauuuga

SEQ ID NO: 205178 - RNA, 1410 nt, Artificial Sequence; identical to SEQ ID NO: 199623
  derived and/or modified sequence opt5 from neuraminidase__InfluenzaA__AFH74535

SEQ ID NO: 205179 - RNA, 1410 nt, Artificial Sequence; identical to SEQ ID NO: 204659
  derived and/or modified sequence opt5 from neuraminidase__InfluenzaA__AFH74546

SEQ ID NO: 205180 - RNA, 1410 nt, Artificial Sequence; identical to SEQ ID NO: 204659
  derived and/or modified sequence opt5 from neuraminidase__InfluenzaA__AFH74557

SEQ ID NO: 205181 - RNA, 1410 nt, Artificial Sequence; identical to SEQ ID NO: 204659
  derived and/or modified sequence opt5 from neuraminidase__InfluenzaA__AFH74568

SEQ ID NO: 205182 - RNA, 1410 nt, Artificial Sequence; identical to SEQ ID NO: 204662
  derived and/or modified sequence opt5 from neuraminidase__InfluenzaA__AFH74579

SEQ ID NO: 205183 - RNA, 1410 nt, Artificial Sequence
  derived and/or modified sequence opt5 from neuraminidase__InfluenzaA__AFH74590
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaaccugaugagcguguga

SEQ ID NO: 205184 - RNA, 1410 nt, Artificial Sequence; identical to SEQ ID NO: 204659
  derived and/or modified sequence opt5 from neuraminidase__InfluenzaA__AFH74601

SEQ ID NO: 205185 - RNA, 1410 nt, Artificial Sequence
  derived and/or modified sequence opt5 from neuraminidase__InfluenzaA__AFH74612
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugagcaaugugcauuccaacaauacgguucgggaucgcacaccguacagaacccuccugaugaacgaacugggcgugcccuuucaccucgggacaaagcaggucuguaucgccuggucuagcuccagcugccaugacggaaaagccuggcugcacguguguauuaccggcgaugacaagaaugcuaccgccucuuucaucuauaacggccggcuuguugauuccguggucagcuggucuaaagagauucugcgcacacaggaauccgagugcguguguaucaaugggacgugcaccguggucaugacagacggaagcgcuuccggcaaggccgauaccaaaauucucuuuaucgaggaagggaagaucguucauacaucuacccugagcggauccgcgcaacacguggaggaaugcagcuguuacccuagauaucccggcgugcggugcgucugucgcgacaacuggaaggggucuaacagaccuauuguggauaucaauauuaaagaccacuccaucguuagcucuuacgugugcagcggacuugucggcgacacgccccggaagaacgauuccucuagcuccagccauugucuggacccgaauaacgaggaaggcgggcacggagugaaaggcugggccuucgaugacgggaaugauguuuggaugggacgcacaauuucugagaaguccagacucggcuacgagaccuuuaaagugaucgaaggguggagcaacccuaagucuaaacugcagaucaaucggcaggucauuguggaccgcggaaacagauccggcuauagcggcaucuucuccgucgaggggaagucuugcauuaaucgguguuuuuacguggaacugaucagaggacgcaaggaggaaaccgagguucucuggacaagcaacuccauuguggucuucugcggcaccucugggacauauggaacgggcagcuggcccgauggggcugacaucaaucugaugccuauuuga

SEQ ID NO: 205186 - RNA, 1410 nt, Artificial Sequence; identical to SEQ ID NO: 204659
  derived and/or modified sequence opt5 from neuraminidase__InfluenzaA__AFH74623

SEQ ID NO: 205187 - RNA, 1410 nt, Artificial Sequence; identical to SEQ ID NO: 204659
  derived and/or modified sequence opt5 from neuraminidase__InfluenzaA__AFH74634

SEQ ID NO: 205188 - RNA, 1410 nt, Artificial Sequence; identical to SEQ ID NO: 204666
  derived and/or modified sequence opt5 from neuraminidase__InfluenzaA__AFH74645

SEQ ID NO: 205189 - RNA, 1410 nt, Artificial Sequence; identical to SEQ ID NO: 204666
  derived and/or modified sequence opt5 from neuraminidase__InfluenzaA__AFH74656

SEQ ID NO: 205190 - RNA, 1410 nt, Artificial Sequence; identical to SEQ ID NO: 204666
  derived and/or modified sequence opt5 from neuraminidase__InfluenzaA__AFH74667

SEQ ID NO: 205191 - RNA, 1410 nt, Artificial Sequence; identical to SEQ ID NO: 204666
  derived and/or modified sequence opt5 from neuraminidase__InfluenzaA__AFH74678

SEQ ID NO: 205192 - RNA, 1410 nt, Artificial Sequence; identical to SEQ ID NO: 199623
  derived and/or modified sequence opt5 from neuraminidase__InfluenzaA__AFH74689

SEQ ID NO: 205193 - RNA, 1410 nt, Artificial Sequence; identical to SEQ ID NO: 199623
  derived and/or modified sequence opt5 from neuraminidase__InfluenzaA__AFH74700

SEQ ID NO: 205194 - RNA, 1410 nt, Artificial Sequence
  derived and/or modified sequence opt5 from neuraminidase__InfluenzaA__AFH74711
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccugugugcggugcgucugucgcgacaacuggaagggcagcaauagaccuaucguggauauuaacaucaaagaccacucuauuguuuccagcuacgugugcucugggcuugucggagacacgccccggaagaaugauagcuccucuagcucccauugucuggacccgaacaaugaggaaggcggccacggggugaaaggaugggccuucgaugacggcaacgauguuuggauggggcgcaccaucagcgagaagucuagacucggauaugagacauuuaaagugaucgaaggcugguccaauccuaagagcaaacugcagauuaaccggcaggucaucguggaccgcgggaauagaucuggauacuccggcauuuucagcgucgagggcaaguccugcaucaaccgguguuuuuauguggaacugauuagagggcgcaaggaggaaaccgagguucucuggaccucuaauagcaucguggucuucugcggaacauccggcaccuacgggacaggaucuuggcccgauggcgcugacauuaaccugaugccuguguga

SEQ ID NO: 205195 - RNA, 1410 nt, Artificial Sequence; identical to SEQ ID NO: 204659
  derived and/or modified sequence opt5 from neuraminidase__InfluenzaA__AFH74722

SEQ ID NO: 205196 - RNA, 1410 nt, Artificial Sequence; identical to SEQ ID NO: 204659
  derived and/or modified sequence opt5 from neuraminidase__InfluenzaA__AFH74733

SEQ ID NO: 205197 - RNA, 1410 nt, Artificial Sequence
  derived and/or modified sequence opt5 from neuraminidase__InfluenzaA__AFH74744
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccaauuacguguguagcggacuugucggcgacacgccccggaagaacgauucuagcuccucuagccauugccuggacccgaauaacgaggaaggcgggcacggagugaaaggcugggccuucgaugacgggaaugauguuuggaugggacgcaccaucuccgagaagucuagacucggcuaugagacauuuaaagugaucgaaggguggucuaacccuaaguccaaacugcagauuaaucggcaggucaucguggaccgcggaaacagaagcggcuacucuggcauuuucuccgucgagggaaagagcuguaucaaucggugcuuuuauguggaacugauuagagggcgcaaggaggaaaccgagguucucuggaccuccaacucuaucguggucuucuguggcacaagcgggaccuacggaacaggcuccuggcccgauggggcugacauuaaucugaugccuguguga

SEQ ID NO: 205198 - RNA, 1410 nt, Artificial Sequence; identical to SEQ ID NO: 204659
  derived and/or modified sequence opt5 from neuraminidase__InfluenzaA__AFH74755

SEQ ID NO: 205199 - RNA, 1410 nt, Artificial Sequence; identical to SEQ ID NO: 204659
  derived and/or modified sequence opt5 from neuraminidase__InfluenzaA__AFH74766

SEQ ID NO: 205200 - RNA, 1410 nt, Artificial Sequence; identical to SEQ ID NO: 204659
  derived and/or modified sequence opt5 from neuraminidase__InfluenzaA__AFH74777

SEQ ID NO: 205201 - RNA, 1410 nt, Artificial Sequence; identical to SEQ ID NO: 199623
  derived and/or modified sequence opt5 from neuraminidase__InfluenzaA__AFH74788

SEQ ID NO: 205202 - RNA, 1410 nt, Artificial Sequence
  derived and/or modified sequence opt5 from neuraminidase__InfluenzaA__AFH74799
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgggccugauaaguguuaccaauucgcucuuggacagggcaccacacugaauaacgugcauagcaauaacaccguucgggaccgcacgccguauagaacacuccugaugaaugaacugggggugcccuuucaccucggaaccaagcaggucugcauugccugguccucuagcuccugucaugauggcaaagccuggcugcacgugugcaucacaggcgacgauaagaacgcuaccgccagcuucauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuauccuagauaccccggggugcggugugucugccgcgauaacuggaagggaagcaauagaccuaucguggacauuaacaucaaagaucacucuauuguuuccagcuacguguguucuggccuugucggcgacacgccccggaagaaugacagcuccucuagcucccauugccuggauccgaacaaugaggaagggggacacggcgugaaagggugggccuucgacgauggaaacgacguuuggaugggccgcaccaucagcgagaagucuagacucggguaugagacauuuaaagugaucgaaggaugguccaauccuaagagcaaacugcagauuaaccggcaggucaucguggaucgcggcaauagaucuggcuacuccgggauuuucagcgucgagggaaaguccuguaucaaccggugcuuuuauguggaacugauuagaggccgcaaggaggaaaccgagguucucuggaccucuaauagcaucguggucuucugugggacauccggaaccuacggcacagggucuuggcccgacggcgcugauauuaaccugaugccuguguga

SEQ ID NO: 205203 - RNA, 1410 nt, Artificial Sequence; identical to SEQ ID NO: 204679
  derived and/or modified sequence opt5 from neuraminidase__InfluenzaA__AFH74810

SEQ ID NO: 205204 - RNA, 1410 nt, Artificial Sequence; identical to SEQ ID NO: 204679
  derived and/or modified sequence opt5 from neuraminidase__InfluenzaA__AFH74821

SEQ ID NO: 205205 - RNA, 1410 nt, Artificial Sequence; identical to SEQ ID NO: 204679
  derived and/or modified sequence opt5 from neuraminidase__InfluenzaA__AFH74832

SEQ ID NO: 205206 - RNA, 1410 nt, Artificial Sequence; identical to SEQ ID NO: 204679
  derived and/or modified sequence opt5 from neuraminidase__InfluenzaA__AFH74843

SEQ ID NO: 205207 - RNA, 1410 nt, Artificial Sequence; identical to SEQ ID NO: 204659
  derived and/or modified sequence opt5 from neuraminidase__InfluenzaA__AFH74854

SEQ ID NO: 205208 - RNA, 1410 nt, Artificial Sequence; identical to SEQ ID NO: 204659
  derived and/or modified sequence opt5 from neuraminidase__InfluenzaA__AFH74865

SEQ ID NO: 205209 - RNA, 1410 nt, Artificial Sequence; identical to SEQ ID NO: 204659
  derived and/or modified sequence opt5 from neuraminidase__InfluenzaA__AFH74876

SEQ ID NO: 205210 - RNA, 1410 nt, Artificial Sequence; identical to SEQ ID NO: 204659
  derived and/or modified sequence opt5 from neuraminidase__InfluenzaA__AFH74887

SEQ ID NO: 205211 - RNA, 1410 nt, Artificial Sequence; identical to SEQ ID NO: 204659
  derived and/or modified sequence opt5 from neuraminidase__InfluenzaA__AFH74898

SEQ ID NO: 205212 - RNA, 1410 nt, Artificial Sequence; identical to SEQ ID NO: 204659
  derived and/or modified sequence opt5 from neuraminidase__InfluenzaA__AFH74909

SEQ ID NO: 205213 - RNA, 1410 nt, Artificial Sequence
  derived and/or modified sequence opt5 from neuraminidase__InfluenzaA__AFH74920
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugaauaacgugcauagcaauaacacgguucgggaucgcacaccguacagaacccuccugaugaaugaacugggcgugcccuuucaccucgggacaaagcaggucuguaucgccugguccucuagcuccugccaugacggaaaagccuggcugcacguguguauuaccggcgaugacaagaacgcuaccgccagcuucaucuauaauggccggcuuguugauucuguggucuccuggagcaaagagauucugcgcacacaggaaucugagugcguguguaucaacgggacgugcaccguggucaugacagacggauccgcuagcggcaaggccgauaccaaaauucucuuuaucgaggaagggaagaucguucauacauccacccugucuggaagcgcgcaacacguggaggaaugcuccuguuacccuagauaucccggcgugcggugcgucugucgcgacaacuggaaggggagcaauagaccuauuguggauaucaacauuaaagaccacucuaucguuuccagcuacgugugcucuggacuugucggcgacacgccccggaagaaugauagcuccucuagcucccauugucuggacccgaacaaugaggaaggcgaucacggggugaaaggaugggccuucgacgauggcaacgacguuuggauggggcgcacaauuagcgagaagucuagacucggauacgagaccuuuaaagugaucgaaggcugguccaauccuaagagcaaacugcagaucaaccggcaggucauuguggaucgcgggaauagaucuggauauuccggcaucuucagcgucgagggcaaguccugcauuaaccgguguuuuuacguggaacugaucagagggcgcaaggaggaaaccgagguucucuggacaucuaauagcauuguggucuucugcggaaccuccggcacauaugggacgggaucuuggcccgacggcgcugauaucaaccugaugccuauuuga

SEQ ID NO: 205214 - RNA, 1410 nt, Artificial Sequence; identical to SEQ ID NO: 199623
  derived and/or modified sequence opt5 from neuraminidase__InfluenzaA__AFH74931

SEQ ID NO: 205215 - RNA, 1410 nt, Artificial Sequence; identical to SEQ ID NO: 199623
  derived and/or modified sequence opt5 from neuraminidase__InfluenzaA__AFH74942

SEQ ID NO: 205216 - RNA, 1410 nt, Artificial Sequence; identical to SEQ ID NO: 204659
  derived and/or modified sequence opt5 from neuraminidase__InfluenzaA__AFH74953

SEQ ID NO: 205217 - RNA, 1410 nt, Artificial Sequence
  derived and/or modified sequence opt5 from neuraminidase__InfluenzaA__AFH74964
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccauccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacaccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacguuuaaagugauugaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaacagagguucucuggaccucuaauagcauuguggucuucuguggcaccuccgggacauacggaaccggcucuuggcccgauggggcugacaucaaccugaugccuguguga

SEQ ID NO: 205218 - RNA, 1410 nt, Artificial Sequence; identical to SEQ ID NO: 204659
  derived and/or modified sequence opt5 from neuraminidase__InfluenzaA__AFH75391

SEQ ID NO: 205219 - RNA, 1410 nt, Artificial Sequence; identical to SEQ ID NO: 199762
  derived and/or modified sequence opt5 from neuraminidase__InfluenzaA__AFH97143

SEQ ID NO: 205220 - RNA, 1410 nt, Artificial Sequence
  derived and/or modified sequence opt5 from neuraminidase__InfluenzaA__AFI56407
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggaaauguguuugucauucgggagccguucaucagcuguucuccccucgaaugccgcaccuuuuuccugacacagggcgcccuucugaacgauaagcauuccaacggcaccauuaaagacagaagcccuuaucggacgcucaugucuugucccaucggggaggugccuucccccuacaauagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccauuaugacggacggaccgagcgauggccaggccucuuacaaaaucuuucgcaucgaaaagggcaaaauugucaagagcguggagaugaacgcucccaauuaucauuacgaagagugcuccuguuacccugacucuagcgagaucacaugcguuugcagagauaacuggcacggguccaaucggcccugggugagcuucaaccagaaucuggaauaucagauuggauacaucuguucuggcauuuuuggggacaacccucgccccaaugauaaaaccggauccugcggcccggugagcucuaacggggccaacggagucaagggcuucuccuuuaaguauggcaaugggguguggaucggaagaacaaaaagcauuuccucucggaagggcuucgagaugaucugggacccuaacggguggaccggaaccgauaauagcuuuuccaucaaacaagacauuguuggcaucaacgaauggucuggguacagcggcuccuucgugcagcaucccgagcuuacaggacuggacuguauucgcccuugcuucugggucgaacucaucagaggccggcccaaggagaauacgauuuggaccagcgggucuuccaucagcuuuuguggagugaacucuggcacaguugggugguccuggcccgauggagcugagcugccuuucaccaucgacaaauga

SEQ ID NO: 205221 - RNA, 1410 nt, Artificial Sequence
  derived and/or modified sequence opt5 from neuraminidase__InfluenzaA__AFJ05141
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaucccugcucaugaaugaacugggcgugccuuuucaccuggggacaaagcaggucugcauugccuggucuagcuccagcugucaugacggaaaagccuggcuccacgugugcaucaccggcgaugacaagaacgcuacagccucuuucauuuacaauggccggcugguugauuccguggucagcuggucuaaagagauccuucgcacccaggaauccgagugugugugcauuaacgggaccuguacaguggucaugacggacggaagcgcuuccggcaaggccgauaccaaaauccuguuuaucgaggaagggaagauuguucauacaucuacccucagcggauccgcgcaacacguggaggaaugcagcugcuaucccagauacccuggcgugcggugugucugccgcgacaacuggaaggggucuaauagacccaucguggauauuaacaucaaagaccacuccauuguuagcucuuacguguguagcggacuggucggcgacacaccgcggaagaaugauuccucuagcuccagccauugccuugacccuaacaaugaggaaggcgggcacggagugaaaggcugggccuucgaugacgggaacgauguuuggaugggacgcaccaucaaugagacgucuagacugggcuaugagacauuuaaggugaucgaagggugguccaaccccaaaagcaagcuccagauuaaucggcaggucaucguggaccgcggagauagaucuggcuacuccggcauuuucagcgucgaggggaaauccuguaucaaccggugcuuuuauguggaacugauuagaggacgcaaggaggaaaccgagguucuguggaccucuaauagcaucguggucuucuguggcacauccgggaccuacggaacaggcucuuggccugacggggcugaucucaaccugaugcccauuuga

SEQ ID NO: 205222 - RNA, 1410 nt, Artificial Sequence
  derived and/or modified sequence opt5 from neuraminidase__InfluenzaA__AFJ05145
augaaccccaaucagaagaucauuaccaucggcagcgugucccugacaaugucuacgauuugcuucuuuaugcaaaucgccauucucaucaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauucuguuuaucgaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgauuaaugagacaagcagacugggcuaugagaccuuuaaggugaucgaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaaccgagguucuguggacauccaauucuauuguggucuucuguggcaccagcgggacauacggaacgggcuccuggccugacggggcugaucucaaccugaugcccaucuga

SEQ ID NO: 205223 - RNA, 1410 nt, Artificial Sequence
  derived and/or modified sequence opt5 from neuraminidase__InfluenzaA__AFJ05635
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucuaugaaacuugcggggaacagcucccugugcccugugagcggaugggcuauuuacucuaaggacaauuccauccggaucggcagcaaaggggauguuuuugugauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggucccuagccccuacaacuccagauuugaaucuguggccuggagcgcuuccgccugccacgacgggauuaacuggcugaccaucggaaucagcggcccugauaauggggcuguugccgugcugaaguauaacggaauuaucacagacaccauuaagucuuggcggaauaacauccuccgcacacaagaguccgagugugcgugcgucaauggcagcuguuucaccauuaugacggaugggccgucugacggacaggccagcuacaaaaucuuuagaaucgaaaagggcaaaauugugaaguccguggagaugaacgcucccaauuaucauuacgaagagugcucuuguuacccugauagcuccgagaucacaugcgucugccgggacaacuggcacggcagcaaucgccccuggguuucuuucaaccagaaucuggaauaucagauuggguacaucuguuccggaauuuuuggcgauaacccuagacccaaugacaaaaccgggagcugcggaccggugucuuccaacggcgccaauggggugaagggauucagcuuuaaguauggcaacggcgucuggaucgggcggacaaaauccauuucuagccgcaagggauucgagaugaucugggauccuaacggcuggaccgggaccgacaauaacuuuuccaucaaacaagacauugugggaaucaaugaauggucuggcuacagcggguccuucguucagcaucccgagcuuacaggccuggauuguauuagaccuugcuucuggguggaacucauccggggacgccccaaggagaacacgauuuggaccagcggcuccuccaucagcuuuuguggggucaauucugacacagugggaugguccuggcccgauggcgcugagcugccuuucaccaucgacaaauga

SEQ ID NO: 205224 - RNA, 1410 nt, Artificial Sequence
  derived and/or modified sequence opt5 from neuraminidase__InfluenzaA__AFJ11709
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucucuggacauccaacucuaucguggucuucuguggcaccagcgggacauacggaacgggcuccuggcccgauggggcugaccugaaucuuaugcugauuuga

SEQ ID NO: 205225 - RNA, 1410 nt, Artificial Sequence
  derived and/or modified sequence opt5 from neuraminidase__InfluenzaA__AFJ11720
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuaucgauucuguuguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucaaugagacaagcagacucggcuaugagaccuuuaagguuauugaaggguggucuaacccuaaauccaagcugcagaucaaucgccaggugauugucgacaaaggaaaccggagcggcuacucuggcaucuucuccguggaggggaagucuuguauuaauagaugcuuuuaugucgaacugauccggggaagaaaggaggaaaccgaggugcucuggacauccaacucuauuguuguguucuguggcaccagcgggacauacggaacgggcuccuggcccgauggggcugaccugaaucuuaugccuaucuga

SEQ ID NO: 205226 - RNA, 1410 nt, Artificial Sequence; identical to SEQ ID NO: 204167
  derived and/or modified sequence opt5 from neuraminidase__InfluenzaA__AFJ11731

SEQ ID NO: 205227 - RNA, 1410 nt, Artificial Sequence
  derived and/or modified sequence opt5 from neuraminidase__InfluenzaA__AFJ19845
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccgacgugcggugugucugccgcgauaacuggaagggcagcaauagaccuaucguggacauuaacaucaaagaccacucuauuguuuccagcuacguguguucugggcuugucggagauacgccccggaagaaugacagcuccucuagcucccauugccuggauccgaacaaugaggaaggcggccacggggugaaaggaugggccuucgacgauggcaacgacguuuggauggggcgcaccaucaaugagacaagcagacucggauaugagaccuuuaaggugaucgaaggcuggucuaacccuaaauccaagcugcagauuaaucggcaggucaucguggauaaagggaaccgcagcggauacucuggcauuuucuccgucgagggcaagagcuguaucaauagaugcuuuuauguggaacugauucgggggagaaaggaggaaaccgagguucucuggacauccaacucuaucguggucuucuguggaaccagcggcacauacgggacgggauccuggcccgacggcgcugaucugaaucuuaugccuauuuga

SEQ ID NO: 205228 - RNA, 1410 nt, Artificial Sequence; identical to SEQ ID NO: 199762
  derived and/or modified sequence opt5 from neuraminidase__InfluenzaA__AFJ44697

SEQ ID NO: 205229 - RNA, 1410 nt, Artificial Sequence; identical to SEQ ID NO: 203281
  derived and/or modified sequence opt5 from neuraminidase__InfluenzaA__AFJ69989

SEQ ID NO: 205230 - RNA, 1410 nt, Artificial Sequence
  derived and/or modified sequence opt5 from neuraminidase__InfluenzaA__AFJ69990
augaaccccaaucagaagaucauuaccaucggcagcgugugcaugacaauugggauggccaaccugauccuccaaauuggaaauaucacguccaucuggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucgcaucggauacaucuguucuggcauuuuuggggauaauccuagacccaacgacaaaacaggauccugcggcccggucagcucuaauggggccaacggagugaagggcuucuccuuuaaguauggcaacgggguuuggaucggacggaccaaaagcauuuccucucgcaauggcuucgagaugaucugggauccuaacggguggaccggaacagacaauaacuuuagcauuaagcaggacaucaucggcauuaaugaaugguccggguacucuggcagcuucgugcaacaucccgagcuuacgggacuggauuguaucagaccuugcuucugggucgaacucauucggggccgccccaaagagaacaccaucuggacauccgggagcucuauuuccuuuuguggagugaauagcgacaccguuggcuggucuuggcccgauggggcugagcugccuuucacaaucgacaaguga

SEQ ID NO: 205231 - RNA, 1410 nt, Artificial Sequence
  derived and/or modified sequence opt5 from neuraminidase__InfluenzaA__AFJ69991
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaaccaagaccugucccacucugccuggagcgcuuccgccugccaugauggaauuaacuggcugaccaucggcaucagcgggccugacaauggagcuguugccgugcucaaguauaacggcauuaucacagauaccauuaagucuuggcgcaauaacauccugagaacacaggaauccgagugugcgugcgucaaugggagcuguuuuaccauuaugacggacggaccgucugauggccaggccagcuacaaaaucuuccggaucgagaagggcaaaauugugaaguccguggaaaugaacgcucccaauuaucacuacgaggaaugcucuuguuacccugacagcuccgagaucacaugcgucugccgcgauaacuggcaugggagcaauagacccuggguuucuuuuaaccagaaucuugaguaucaaauuggauacaucuguuccggcauuuucggggacaacccucggcccaaugauaaaaccggaagcugcggcccggugucuuccaacggggccaauggagugaagggcuuuagcuucaaguauggcaacggggucuggaucggacgcacaaaauccauuucuagcagaaagggcuuugaaaugaucugggacccuaacggguggaccggaaccgacaauaacuucuccaucaaacaggauauugugggcaucaaugaguggucuggguacagcggcuccuuuguucagcaccccgaacugacaggacucgacuguauucggccuugcuucuggguggagcugauccgcggcagacccaaggaaaacacgauuuggaccagcgggucuuccaucagcuucuguggagucaauucugauacagugggcugguccuggcccgacggggcugagcuuccuuuuaccaucgauaaauga

SEQ ID NO: 205232 - RNA, 1410 nt, Artificial Sequence; identical to SEQ ID NO: 200588
  derived and/or modified sequence opt5 from neuraminidase__InfluenzaA__AFJ69992

SEQ ID NO: 205233 - RNA, 1410 nt, Artificial Sequence
  derived and/or modified sequence opt5 from neuraminidase__InfluenzaA__AFJ69993
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucgugggacgcggcaacagaagcggcuacucugggauuuucuccgucgagggaaaaagcuguaucaaucggugcuuuuauguggaacugauuagaggccgcaaggaggaaaccgagguucucuggacauccaacucuaucguggucuucugugggaccagcggaacauacggcacgggguccuggcccgacggcgcuaaucugaaccuuaugccuauuuga

SEQ ID NO: 205234 - RNA, 1410 nt, Artificial Sequence; identical to SEQ ID NO: 202542
  derived and/or modified sequence opt5 from neuraminidase__InfluenzaA__AFJ69994

SEQ ID NO: 205235 - RNA, 1413 nt, Artificial Sequence
  derived and/or modified sequence opt5 from neuraminidase__InfluenzaA__AFJ74389
augaaccccaaucagaagaucauuaccaucggcagcauuuccaucgccauugggaucaucucucugauucuccaaaucggaaacauuaucagcauuugggcuucccacucuauccagacaggcagccagaaucauacgggggugugcaaccagagaauuaucaccuacgagaauagcacaugggucaaccaaaccuauguuaauaucaacaauacaaacgugguggccggaaaagacaagaccucuaugacacuggcgggcaauagcucccuuuguccuauucgggggugggcuaucuacaccaaagauaacagcauucgcaucggaucuaagggcgacgucuucgugauuagagaaccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggccugggguggcugaccaucggaauuagcggccccgacaacggggcggucgccgugcucaaguauaacggaaucauuacagaaaccaucaaauccuggaagaaacgcauucugagaacgcaggagagcgagugcguuuguaugaauggcucuugcuuuacaaucaugaccgauggcccuuccaacggggcugccagcuaccggaucuucaagauugaaaaaggacgcgugacaaagucuaucgagcuugacgcuccgaauuaucauuacgaagaguguagcugcuaccccgauaccggcaccgucaugugugugugcagagacaacuggcacggguccaaucggccuugggugucuuuuaaccagaaucuggauuaucaaauuggauacaucugcagcggcgucuucggggacaacccccgcccuaaggauggagagggcuccuguaaucccguuacaguggacggcgccgacggggugaaaggauuuagcuauagauacggcaacggggucuggauuggacggacgaagucuaaucgccucagaaaaggcuucgaaaugaucugggauccgaacggguggaccgacacagauuccgacuuuagcaugaagcaggauauuguggcgaugaccgacuggucuggcuauuccggauccuucguucagcacccugagcugacaggccuugauugcaugcggcccuguuuuuggguggaacuggucagagggcucccucgcgagaauaccacgaucuggacauccggaucuagcaucuccuucugcggcgugaacucugacaccgccaauuggagcuggcccgauggggcugaacugcccuucaccauugacaaauga

SEQ ID NO: 205236 - RNA, 1410 nt, Artificial Sequence
  derived and/or modified sequence opt5 from neuraminidase__InfluenzaA__AFJ74399
augaaccccaaucagaagaucauuaccaucggcagcgugucccugacaauugccacgaucugcuuccucaugcaaauugcuauccuggucaucacccuuacacugcacuuuaaacaguacgaguguaacucuccuccgaauaaccagguuaugcucugcgaacccaccauuaucgagagaaauauuacagaaaucguguaucugaccaacacaaccauugagaaggaaaucuguccuaaacuugccgaguaccggaauuggagcaagccccagugcaaaauuacgggguucgcgccuuuuuccaaggacaacucuauccgccugagcgcuggaggcgauaucugggugaccagagagcccuaugucuccugugacccugggaagugcuaccaauucgcccucggacagggcacaacccugaauaaccggcauucuaaugauacagugcacgaccgcaccccguauagaacgcugcucaugaacgaacuggggguucccuuucaucuuggaacaaaacagguguguauugccuggagcuccagcucuugccacgauggcaaggcuuggcugcaugucugugugaccggccacaaugagaacgccacagcuuccuucaucuacgacgggcggcucguugauagcauuggaucuugguccaaaaauauccugcgcacccaggaaagcgagugcguguguauuaacggaaccugcacagucgugaugacggacgggucugccuccggcagagcggauaccaagauccuuuuuaucgaggaaggcaaaauugugcacaucagcccucuguccgggucugcccaacaugucgaggaaugcagcuguuauccccgguacccuggaguucgcugcguguguagagacaacuggaagggcuccaaucggcccauuguggauaucaacgucaaggacuucagcauugugucuuccuacguuugcagcggccucgugggggauacaccgcgcaaaaaugacucuagcuccucuagccacugucugaacccuaauaacgaggaaggaggccauggggucaagggaugggcuuuugacgauggcaaugacguguggauggggagaaccaucuccgagaaacugcggagcggauaugagacauucaagguuaucggcggcuggucuaaacccaacuccaagcuccagauuaaucgccaggugaucgucgauagagggaaccggagcggauacucuggcaucuuuuccguggaagggaaaagcugcauuaauagauguuucuaugucgagcugauucgcggacggaagcaggaaaccgaggugugguggacguccaacucuaucguuguguuuugcggcacaagcgggaccuacggcaccggauccuggccugacggcgccgauauuaaucuuaugcccaucuga

SEQ ID NO: 205237 - RNA, 1410 nt, Artificial Sequence
  derived and/or modified sequence opt5 from neuraminidase__InfluenzaA__AFJ74410
augaaccccaaucagaagaucauuaccaucggcagcgugucccugacaauugccacgaucugcuuccucaugcaaauugcuauccuggucaugaccguuacacuucacuuuaaacaguacgaguguaacucuccuccgaauaaccaggugaugcugugcgaacccaccaucauugagagaaauaucacagaaauuguguaucucaccaacacaaccaucgagaaggaaauuuguccuaaacuggccgaguaccggaauuggagcaagccccagugcaaaaucacgggguucgcgccuuuuuccaaggacaacucuauucgccuuagcgcuggaggcgauaucugggucaccagagagcccuauguguccugugacccugggaagugcuaccaauucgcccugggacagggcacaacccucaauaaccggcauucuaaugauacaguucacgaccgcaccccguauagaacgcugcugaugaacgaacucggggugcccuuucaucugggaacaaaacaggucuguaucgccuggagcuccagcucuugccacgauggcaaggcuuggcuucauguguguguuaccggccacaaugagaacgccacagcuuccuucauuuacgacgggcggcugguggauagcaucggaucuugguccaaaaauauucuccgcacccaggaaagcgagugcgucuguaucaacggaaccugcacaguggugaugacggacgggucugccuccggcagagcggauaccaagauucuguuuaucgaggaaggcaaaaucguccacauuagcccucuuuccgggucugcccaacauguugaggaaugcagcuguuauccccgguacccuggagugcgcugcguguguagagacaacuggaagggcuccaaucggcccaucgucgauauuaacgugaaggacuacagcaucauuucuuccuauguuugcagcggccuggugggggauacaccgcgcaaaaaugacucuagcuccucuagccacugucucaacccuaauaacgaggaaggaggccauggggucaagggaugggcuuucgacgauggcaaugacguguggauggggagaaccaucuccgagaaacugcggagcggauacgagacauuuaagguuaucggcggcuggucuaaacccaacuccaagcugcagauuaaucgccaggugaucgucgauagagggaaccggagcggauauucuggcauuuucuccguggaagggaaaagcugcaucaauagauguuuuuacgucgagcucauucgcggacggaagcaggaaaccgaggugugguggacguccaacucuaucguuguguucugcggcacaagcgggaccuauggcaccggauccuggccugacggcgccgauauuaaucugaugcccaucuga

SEQ ID NO: 205238 - RNA, 1410 nt, Artificial Sequence; identical to SEQ ID NO: 197339
  derived and/or modified sequence opt5 from neuraminidase__InfluenzaA__AFJ74451

SEQ ID NO: 205239 - RNA, 1413 nt, Artificial Sequence
  derived and/or modified sequence opt5 from neuraminidase__InfluenzaA__AFJ74462
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagagaauuaucaccuaugaaaauuccacaugggucaaccaaaccuacguuaauaucaacaauacaaacgugguggccggaaaagacaagaccucuaugacacuggcgggcaauagcucccuuuguccuauucgggggugggcuaucuauaccaaagauaacagcauucgcaucggaucuaagggcgacgucuucgugauuagagagccguuuaucuccugcagccaucuggagugucggacguucuuucucacccagggcgcccugcuuaaugauaaacacucuaacgggacaguuaaggaccgcucccccuacagagcccugaugagcugcccucucggagaagcucccucuccuuauaauucccgguucgagagcguggccugguccgcuucugccugucaugauggccugggguggcugaccaucggaauuagcggccccgacaacggggcggucgccgugcucaaguacaacggaaucauuacagaaaccaucaaauccuggaagaaacagauucugcgcacgcaggagagcgagugcguuugugugaauggcucuugcuuuacaaucaugaccgauggcccuuccaacagagcugccagcuaucggaucuucaagauugaaaaagggcgcgucacaaagucuaucgagcuugacgcuccgaauuaccacuacgaagaguguagcugcuaucccgauaccggaaccgugaugugugugugcagagacaacuggcauggcuccaaucggccuugggucucuuuuaaccaaaaucuggauuaccagauuggguauaucugcagcggaguuuucggcgacaacccccgcccuaaggauggggagggauccuguaaucccgugacaguggacggcgccgacggcgucaaaggguuuagcuacagauauggaaacggcguguggauugggcggacgaagucuaaucgccucagaaaaggauucgaaaugaucugggauccgaacggcuggaccgacacagauuccgacuuuagcaugaagcaggauguuguggcgaugaccgacuggucuggguacuccggcagcuucguccagcacccugagcugacaggacuugauugcaugcggcccuguuuuuggguggaacugguuagaggccucccucgcgagaauaccacgauuuggacauccgggucuagcaucuccuucugcggagugaacucugaaaccgccaauuggagcuggcccgacggcgcugagcugcccuucaccaucgauaaauga

SEQ ID NO: 205240 - RNA, 1410 nt, Artificial Sequence
  derived and/or modified sequence opt5 from neuraminidase__InfluenzaA__AFJ74517
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguauaugacaaacaccacgaucgagaaggaaauuuguccuaaacucgccgaguaccggaauuggagcaagccccagugcaaaaucaccggguucgcgccuuuuuccaaggacaacucuauucgccugagcgcuggaggcgauaucugggucacaagagagcccuauguguccugugacccugauaagugcuaccaauucgcccuugggcagggaaccacacugaauaaccggcauucuaaugacaccguucacgaucgcacgccguauagaacacuccugaugaacgaacugggcgugcccuuucaucucgggaccaaacaggucuguaucgccuggagcuccagcucuugccacgacggaaaggcuuggcugcauguguguguuacaggccacgaugagaaugccaccgcuuccuucauuuacgacggccggcuuguggauagcaucgggucuugguccaaaaagauucugcgcacccaggaaagcgagugcgucuguaucaacggaacaugcacgguggugaugaccgacggcucugccuccgggagagcggauacaaaaauucucuuuaucgaggaaggaaagaucguccacauuagccaacuguccggcucugcccagcauguugaggaaugcagcuguuauccucgguaccccggggugcgcugcguguguagagacaauuggaagggauccaaccggccuaucgucgauauuaacgugaaagacuacagcaucguuucuuccuaugugugcagcggccuugucggcgacacaccccgcaagaaugauucuagcuccucuagccacugucugaacccgaauaacgaggaagggggacauggcgugaaagggugggcuuucgacgauggaaaugacguuuggaugggcagaaccauuuccgagaagcuccggagcggguacgagaccuuuaaagugaucgaaggauggucuaagccuaacuccaaacugcagaucaaucgccaggucauuguggauagaggcaaccggagcggcuauucugggaucuucuccgucgagggaaagagcugcauuaauagauguuuuuacguggaacugauccgcggccggaagcaagagaacgaaguuugguggacguccaauucuauuguggucuucugcgggacaagcggaaccuauggcaccggguccuggcccgacggcgccgauaucaaccucaugccuauuuga

SEQ ID NO: 205241 - RNA, 1410 nt, Artificial Sequence
  derived and/or modified sequence opt5 from neuraminidase__InfluenzaA__AFJ74564
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaccgagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaagacaggucuguaucgccuggagcuccagcucuugccacgacggcaaggcuuggcuucauguguguguuaccggcgaugacgagaacgccaccgcuuccuucaucuacaaugggcggcugguggauagcauuggaucuugguccaaaaagauccuccgcacacaggaaagcgagugcgucuguauuaacggcacgugcaccguggugaugacagacgggucugccuccggaaaagcggauaccaagauccuguuuauugaggaaggcaaaaucguccacaucagcacacuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacgccccggaaaaaugauucuuucagcuccucucauugucucgacccgaacaaugaggaaggaggccacggggugaagggaugggcuuuugaugacggcaacgauguuuggauggggcgcaccaucagcgagacacugagauccggauacgagaccuucaaagugauugaaggcuggagcaagccuaauucuaaacugcagaucaaccggcaggucaucguggagcgcggcaauagauccggguauagcggaaucuuuucugucgaaggcaaguccugcauuaaccgguguuucuacguggagcucauuagagggcgcaaagaagagaccgagguuugguggacaagcaauuccaucguggucuuuugcggaaccucuggcacauaugggacgggcagcuggcccgacggagccgauauuaaccugaugccuaucuga

SEQ ID NO: 205242 - RNA, 1413 nt, Artificial Sequence
  derived and/or modified sequence opt5 from neuraminidase__InfluenzaA__AFJ74639
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauaacacaugggugaaucacaccuaugucaacaucaauaacacaaauguuguggccggaaaagacaagaccuccgugacacuggcgggcaacucuagccuuuguuccauuagcgggugggcuaucuacaccaaagauaauucuauucggaucggauccaagggcgacgucuucgugauucgcgaaccuuuuaucagcugcucucaucuggaguguagaacguucuuucucacccaaggcgcccugcuuaacgauaaacacuccaaugggacaguuaaggaccggagcccguaucgcgcccugaugucuugcccccucggagaagcuccuucccccuacaacagcaaguucgaguccguggccuggucugcuagcgccugucaugauggcaugggguggcugaccaucggaauuuccggcccugacaacggggcggucgccgugcugaaauauaauggaaucauuacagaaaccaucaagagcuggaaaaagcggauucucagaacgcaggagucugagugcguuuguaugaacggcuccugcuuuacaaucaugaccgauggccccagcaauggggcugccucuuacaaaaucuucaagauugaaaagggaaaagugacaaagagcaucgagcugaacgcuccuuccuuucacuaugaagaguguucuugcuacccggacaccggcaccgucaugugugugugccgcgauaauuggcacgggagcaacagacccuggguguccuucaaucagaaccuugacuaccagauuggauauaucugcagcggcgucuuuggggauaauccucggcccaaagacggagagggcucuuguaacccuguuacaguggauggcgccgacggggugaagggauucuccuacaaauauggcaauggggucuggauuggacgcaccaagagcaacagacugcggaaaggcuuugaaaugaucugggaccccaauggguggacgaacacagauucugacuucuccgugaagcaagauguuguggcgauuaccgacuggagcggcuacuccggaucuuuuguccagcauccggagcucacaggccuggauugcauccgcccuuguuucuggguggaacuuguuagagggcugccccgggagaauaccacgaucuggacaagcggauccucuauuagcuucugcggcgugaacuccgacaccgccaacuggagcuggccugauggggcugaacuccccuuuaccaucgacaaguga

SEQ ID NO: 205243 - RNA, 1410 nt, Artificial Sequence
  derived and/or modified sequence opt5 from neuraminidase__InfluenzaA__AFJ74640
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcuggguaccggaauugguccaagccccaguguaacauuaccggauucgccccuuuuucuaaagacaauagcauccgccuguccgcgggcggggauaucugggugacaagagagcccuaugucucuugcgacccugauaaguguuaccaauucgcucuuggacagggcaccacacugaacaaugugcauagcaacgacaccguucacgaucggacgccguaucgcacacuccugaugaaugagcugggggugcccuuucaucucggaaccaagcaggucugcauugccugguccucuagcuccugucacgacggcaaagccuggcugcaugugugcguuacaggcgaugacgaaaacgcuaccgccagcuucaucuacaaugggagacuuguggauucuauugucuccuggagcaagaaaauccugcggacccaggagucugaaugugugugcauuaacggaacauguacgguggucaugaccgacggcuccgcuagcgggaaggccgauacaaaaauccucuuuaucgaggagggaaagauuguucacaccuccacacugucuggcagcgcgcaacacguggaagagugcuccugcuauccucgcuaccccggggugagaugugucugccgggacaacuggaagggaagcaaucgcccuaucguggauauuaacaucaaagacuacucuauuguuuccagcuauguguguucuggccuugucggcgacacccccagaaagaaugauagcuccucuagcucccauugccuggacccgaacaaugaagaagggggacacggcgugaaagggugggccuucgaugacggaaacgauguuuggaugggccggacgaucagcgagaagcuccgcucuggguacgagacauuuaaagugaucgagggaugguccaauccuaacagcaagcugcagauuaauagacaggucaucguggacaaaggcaaccggucuggcuauuccgggauuuucagcgucgaaggaaaguccuguaucaaucgcugcuuuuacguggagcugauuagaggccggaagcaggaaaccgagguucucuggaccucuaacagcaucguggucuucugugggacauccggaaccuauggcacagggucuuggcccgauggcgcugacauuaaucugaugccuaucuga

SEQ ID NO: 205244 - RNA, 1413 nt, Artificial Sequence; identical to SEQ ID NO: 205242
  derived and/or modified sequence opt5 from neuraminidase__InfluenzaA__AFJ74659

SEQ ID NO: 205245 - RNA, 1413 nt, Artificial Sequence
  derived and/or modified sequence opt5 from neuraminidase__InfluenzaA__AFJ74679
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauaacacaugggugaaucacaccuaugucaacaucaauaacacaaauguuguggccggaaaagacaagaccuccgugacacuggcgggcaacucuagccuuuguuccauuagcgggugggcuaucuacaccaaagauaauucuauucggaucggauccaagggcgacgucuucgugauucgcgaaccuuuuaucagcugcucucaucuggaguguagaacguucuuucucacccaaggcgcccugcuuaacgauaaacacuccaaugggacaguuaaggaccggagcccguaucgcgcccugaugucuugcccccucggagaagcuccuucccccuacaacagcaaguucgaguccguggccuggucugcuagcgccugucaugauggcaugggguggcugaccaucggaauuuccggcccugacaacggggcggucgccgugcugaaauauaauggaaucauuacagaaaccaucaagagcuggaaaaagcggauucucagaacgcaggagucugagugcguuuguaugaacggcuccugcuuuacaaucaugaccgauggccccagcaauggggcugccucuuacaaaaucuucaagauugaaaagggaaaagugacaaagagcaucgagcugaacgcuccuuccuuucacuaugaagaguguucuugcuacccggacaccggcaccgucaugugugugugccgcgauaauuggcacgggagcaacagacccuggguguccuucaaucagaaccuugacuaccagauuggauauaucugcagcggcgucuuuggggauaauccucggcccaaagacggagagggcucuuguaacccuguuacaguggauggcgccgacggggugaagggauucuccuacaaauaugacaauggcgucuggauugggcgcaccaagagcaacagacugcggaaaggauuugaaaugaucugggaucccaauggcuggacgaacacagacucugauuucuccgugaagcaagacguuguggcgauuaccgauuggagcggguacuccggcucuuuuguccagcauccggagcucacaggacuggacugcauccgcccuuguuucuggguggaacuuguuagaggccugccccgggagaauaccacgaucuggacaagcggguccucuauuagcuucugcggagugaacuccgauaccgccaacuggagcuggccugacggcgcugaacuccccuuuaccaucgauaaguga

SEQ ID NO: 205246 - RNA, 1410 nt, Artificial Sequence
  derived and/or modified sequence opt5 from neuraminidase__InfluenzaA__AFJ74680
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuauucuuugugaacccacaaucauugagagaaauaucaccgaaauuguguaucugacaaacaccacgaucgagaaggaaauuugcccuaaacucgcugaguaccggaauugguccaagccccaguguaacaucaccggguucgccccuuuuucuaaagacaauagcauccgccuguccgcgggaggcgauauuugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcaucgccugguccucuagcuccugucacgacggaaaagccuggcugcaugugugcguuacaggcgaugacgagaacgcuaccgccagcuucauuuacaauggcagacuuguggauucuaucgucuccuggagcaagaaaauucugcggacccaggaaucugagugugugugcaucaacgggacauguacgguggucaugaccgacggauccgcuagcggcaaggccgauacaaaaauccucuuuauuaaggaggggaagaucguucacaccuccacacugucuggaagcgcgcaacacguggaagagugcuccugcuauccucgcuaccccggcgugagaugugucugccgggacaacuggaaagggagcaaucgcccuauuguggauaucaacauuaaggacuacucuaucguuuccagcuauguguguucuggacuugucggcgacacccccagaaagaaugauagcuccucuagcucccauugccuggacccgaacaaugaagagggcgggcacggagugaaaggcugggccuucgaugacgggaacgauguuuggaugggacggacgaucagcgaaaaacuccgcucuggcuacgagacauuuaaggugauugaggggugguccaauccuaacagcaaacugcagaucaauagacaggucauuguggaccggggaaaccgcucuggcuauuccggcaucuucagcgucgaagggaaguccuguauuaauagaugcuuuuacguggagcugauccggggaagaaagcaggaaaccgagguucucuggaccucuaacagcauuguggucuucuguggcacauccgggaccuauggaacaggcucuuggcccgauggggcugacaucaaucugaugccuaucuga

SEQ ID NO: 205247 - RNA, 1410 nt, Artificial Sequence
  derived and/or modified sequence opt5 from neuraminidase__InfluenzaA__AFJ74701
augaaccccaaucagaagaucauuaccaucggcagcgugucccugacaauugccacgaucugcuuccucaugcaaauugcuauccuggucaccacaguuacccuucacuuuaaccaguacgaguguaauucuccuccgaacaaucaggugaugcugugcgaacccacaaucauugagagaaacaucaccgaaauuguguaucucacaaauaccacgaucgagaaagaaauuuguccuaagcuggccgaguaccggaucuggagcaaaccccagugcaacauuaccggguucgcgccuuuuuccaaggacaauucuauccgccuuagcgcuggaggcgauaucugggucacaagagagcccuauguguccugugacccugauaaaugcuaccaauucgcccuggggcagggaaccacacucaacaauggccauucuaacgacaccguucacgaucggacgccguaucgcacacugcugaugaaugaacucggggugcccuuucaucugggaaccagacaggucuguauggccuggagcuccagcucuugccacgacggcaaggcuuggcuucauguguguguuacaggcgaugacgagaacgccaccgcuuccuucauuuacaaugggcggcugguggauagcaucggaucuugguccaagaaaauucuccgcacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccuagauaccccggagugcggugcgugugucgcgacaacuggaaaggcuccaauagaccuaucgucgauauuaacgugaaggacuacagcaucguuucuuccuaugugugcagcggccuggucggggacacaccccggaagaaugauucuuucagcuccucucauugucucgacccgaacaaugaggaaggaggccacggggugaaaggaugggcuuuugaugacggcaacgauguuuggauggggcgcaccauuagcgagaagcugagauccggauacgagacguucaaagugaucgaaggcuggagcaagccuaauucuaaacugcaggucaaccgccaggugaucgucgagcggggcaauagauccggguauagcggaaucuuuucuguggaaggcaaguccugcauuaaccgguguuucuacguugagcucauuagagggcgcaaagaagagacagaggugugguggaccagcaauuccaucgucguguuuugcggaaccucuggcacauaugggaccggcagcuggcccgacggagccgauauuaaccugaugccuaucuga

SEQ ID NO: 205248 - RNA, 1410 nt, Artificial Sequence
  derived and/or modified sequence opt5 from neuraminidase__InfluenzaA__AFJ74731
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagacggauagcuccucuagcucccauugccuggacccgaauaacgaggaaggcgggcacggagugaaaggcugggccuucgaugacgggaaugauguuuggaugggacggacaaucagcgagaagcuccgcucuggcuacgagaccuuuaaagugaucgaagggugguccaacccuaauagcaagcugcagauuaacagacaggucaucguggaccggggaaaucgcucuggcuauuccggcauuuucagcgucgaggggaaauccuguaucaacagaugcuuuuacguggaacugauucggggaagaaaucaggagaccgaaguucucuggacaucuaacagcaucguggucuucuguggcaccuccgggacauauggaacgggcucuuggcccgauggggcugagauuaaucugaugccuaucuga

SEQ ID NO: 205249 - RNA, 1413 nt, Artificial Sequence; identical to SEQ ID NO: 205242
  derived and/or modified sequence opt5 from neuraminidase__InfluenzaA__AFJ74766

SEQ ID NO: 205250 - RNA, 1410 nt, Artificial Sequence
  derived and/or modified sequence opt5 from neuraminidase__InfluenzaA__AFJ74767
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaccaggagaccgaaguucucuggaccucuaauagcaucguggucuucuguggcacauccgggaccuauggaacaggcucuuggcccgauggggcugacauuaaccugaugccuaucuga

SEQ ID NO: 205251 - RNA, 1410 nt, Artificial Sequence; identical to SEQ ID NO: 205250
  derived and/or modified sequence opt5 from neuraminidase__InfluenzaA__AFJ74783

SEQ ID NO: 205252 - RNA, 1410 nt, Artificial Sequence; identical to SEQ ID NO: 197169
  derived and/or modified sequence opt5 from neuraminidase__InfluenzaA__AFJ74807

SEQ ID NO: 205253 - RNA, 1410 nt, Artificial Sequence; identical to SEQ ID NO: 197169
  derived and/or modified sequence opt5 from neuraminidase__InfluenzaA__AFJ74822

SEQ ID NO: 205254 - RNA, 1410 nt, Artificial Sequence; identical to SEQ ID NO: 197738
  derived and/or modified sequence opt5 from neuraminidase__InfluenzaA__AFJ74834

SEQ ID NO: 205255 - RNA, 1410 nt, Artificial Sequence; identical to SEQ ID NO: 197169
  derived and/or modified sequence opt5 from neuraminidase__InfluenzaA__AFJ74845

SEQ ID NO: 205256 - RNA, 1413 nt, Artificial Sequence
  derived and/or modified sequence opt5 from neuraminidase__InfluenzaA__AFJ75039
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaacaauaccuaugucaacaucaauaacacaucuguuguggccgaaaaagacaagaccagcgugacacuggcgggaaauuccagccuuuguucuauuuccggcugggcuaucuacaccaaagauaacagcauucggaucgggucuaagggagacgucuucgugauucgcgagccuuuuaucuccugcagccaccuggaauguagaacguucuuucucacccaaggcgcccugcuuaaugauaaacauucuaacggcacaguuaaggaccgguccccguaucgcgcccugaugagcugcccccucggggaggcuccuucccccuacaauucuaaguucgaaagcguggccugguccgcuagcgccugucacgauggaaugggcuggcugaccaucgggauuucuggaccugacaacggcgcggucgccgugcugaaauauaacgggaucauuacagagaccaucaaguccuggaaaaagcggauucucagaacgcaggagagcgaaugcguuuguaugaauggaucuugcuuuacaaucaugaccgauggccccagcaacggcggggcuuccuacaaaaucuucaagauugagaagggaaaagugacaaagucuaucgaacugaaugccccuaacuuucauuaugaggaguguagcugcuacccggacaccggcaccgucaugugugugugccgcgauaauuggcacggguccaacagacccugggugagcuucaaucagaaccuugacuaccagauuggauauaucugcucuggcgucuuuggggauaauccucggcccaaagacggagaaggcuccuguaacccuguuacaauugauggcgcugacggggugaagggauucagcuacaaauauggcaaugggguguggaucggacgcacgaagucuaacagacugcggaaaggcuuugagaugauuugggaccccaauggguggaccaacacagauuccgacuucagcgucaagcaagaugugguugccaucaccgacugguccggcuacucuggauccuuugugcagcacccggaacucacaggccuggauugcauccgcccuuguuucugggucgagcuugugagagggcugccccgggaaaauaccacgauuuggacauccggaucuagcaucuccuucugcggcguuaacagcgacaccgcgaacuggucuuggccugauggggccgagcuccccuuuaccauugacaaguga

SEQ ID NO: 205257 - RNA, 1410 nt, Artificial Sequence
  derived and/or modified sequence opt5 from neuraminidase__InfluenzaA__AFJ75050
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcgugcgccuguccgcgggaggcgauaucugggucacaagagagcccuaugugucuugcgacccugauaaguguuaccaauucgcucuugggcagggaaccacacugaacaauguucauagcaacgacaccgugcacgaucggacgccguaucgcacacuccugaugaaugaacugggcguccccuuucaucucgggaccaaacaggugugcaucgccugguccucuagcuccugucacgacggaaaggccuggcugcauguuugcgugacaggcgaugacaagaacgcuaccgccagcuucauuuacaauggcagacuugucgauucuaucguguccuggagcaaagagauucugcggacccaggaaucugagugugugugcaucaacgggacauguacggucguuaugaccgacggauccgcuagcggcaaggccgauacaaaaauucucuuuaucguggaggggaagaucgugcacaccuccgcgcugucuggaagcgcccaacacgucgaagagugcuccugcuauccucgcuaccccggcgugagauguguuugccgggacaacuggaaggggagcaaucgcccuauuguggauaucaacauuaaagacuacucuaucgucuccagcuauguguguucuggacuuguuggcgacacacccagaaagaaugauagcuccucuagcucccauugccuggacccgaacaaugaagagggcgggcacggagugaaaggcugggcuuucgaugacgggaacgaugucuggaugggacggaccauuagcgaaaagcuccgcucuggcuacgagacguuuaaagugaucgaggggugguccaauccuaacagcaagcugcagaucaauagacaggucauuguggaccggggaaaccgcucuggcuauuccggcaucuucagcguugaagggaaauccuguauuaauagaugcuuuuacguggagcugauccggggaagaaaggaagagacagaaguccucuggaccucuaacagcauugugguuuucuguggcaccuccgggacauauggaaccggcucuuggcccgauggggccgacaucaaucugaugccuauuuga

SEQ ID NO: 205258 - RNA, 1410 nt, Artificial Sequence
  derived and/or modified sequence opt5 from neuraminidase__InfluenzaA__AFJ75094
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuaagcucgcugaguacagaaauugguccaaaccccagugugacauuaccggguucgccccuuuuucuaaggauaacagcauccggcuguccgcgggaggcgacaucugggugacacgcgagcccuaugucucuugcgauccugacaaguguuaccaauucgcucuugggcagggaaccacacugaauaacgugcauagcaaugauaccguuagagaccggacgccguaucgcacacuccugaugaacgaacugggcgugcccuuucaccucgggaccaaacaggucugcauugccugguccucuagcuccugucaugauggaaaggccuggcugcacgugugcaucacaggcgacgauaaaaaugcuaccgccagcuucauuuacaacggcagacuuguugacucuaucguguccuggagcaaggagauucugcggacccaggaaucugagugugucugcaucaaugggacauguacgguggugaugaccgauggauccgcuagcggcaaagccgacacaaagauccucuuuauugaggaagggaagaucguccauaccuccacacugucuggaagcgcgcaacacguugaggaaugcuccugcuauccucgcuaccccggcgugagaugugugugccgggauaacuggaaagggagcaaccgcccuauugucgacaucaauauuaaggaccacucuaucguguccagcuacguuuguucuggacuugugggcgauacccccagaaagaacgacagcuccucuagcuccaauugccuggauccgaacaaugaggaaggcgggcauggagucaaaggcugggccuucgacgaugggaacgacguguggaugggacggacgaucagcgagaaaucucgccucggcuaugagacauuuaagguuauugaagggugguccaauccuaacagcaaacugcagaucaauagacaggugauugucgaucggggaaaccgcucuggcuacuccggcaucuucagcguggaggggaaguccuguauuaauagaugcuuuuaugucgaacugauccggggaagaaaggaggaaauugaggugcucuggaccucuaacagcaucguuguguucuguggcaccuccgggacauacggaaccggcucuuggcccgacggggcugauaucaauauuaugccuaucuga

SEQ ID NO: 205259 - RNA, 1413 nt, Artificial Sequence
  derived and/or modified sequence opt5 from neuraminidase__InfluenzaA__AFJ75104
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggcgggcaauucuagccuuuguuccauuagcgggugggcuauccauaccaaagauaacucuauucggaucggauccaagggcgacgucuucgugauucgcgagccguuuaucagcugcucucaccuggaguguaaaacguucuuucucacccaaggcgcccugcuuaaugauaagcauuccaacgggacaguuaaggacagaagccccuaccgggcccugaugucuugcccucucggagaagcucccuccccuuauaauagcaaauucgaguccguggccuggucugcuagcgccugucacgauggcaucggguggcugaccauuggaaucuccggccccgacaacggggcggucgccgugcugaaguacaacggaauuaucacaggcaccauuaaaagcuggaagaaacagauccuccgcacgcaggaaucugagugcguuuguaugaauggcuccugcuuuacaaucaugaccgaugggccuagcaacggagcugccucuuauaagauuuucaagaucgagaaaggcaaggugacaaaaagcauggaacugaaugcuccgaacuuucacuacgaggaauguuccugcuaucccgacaccgggaccgucaugugugugugcagagauaauuggcauggaucuaaccggccuugggugagcuucaaucagaaccuugacuaccaaauuggcuacaucugcuccggggucuuuggagauaauccccgcccugaggacggcgagggcagcuguaaccccguuacaguggauggggccaauggagugaagggcuucucuuauaaauacgggaacggagucuggauuggcagaacgaaguccaaucggauccgcaaaggguuugaaaugauuugggacccgaacggcuggaccaauacagacagcgauuucucugugaagcaggacaucguugcgaucaccgauugguccggauauagcggcuccuuugugcagcacccugagcugacagggcucgacugcauuagacccuguuucugggucgaacuggugcggggacuuccucgcgagaacaccacgaucuggacaucuggcagcuccauuucuuucugcgggguuaacagcgauaucgccaauugguccuggcccgacggagcugaacugcccuuuaccauugauaaguga

SEQ ID NO: 205260 - RNA, 1410 nt, Artificial Sequence; identical to SEQ ID NO: 198908
  derived and/or modified sequence opt5 from neuraminidase__InfluenzaA__AFJ75114

SEQ ID NO: 205261 - RNA, 1410 nt, Artificial Sequence; identical to SEQ ID NO: 198908
  derived and/or modified sequence opt5 from neuraminidase__InfluenzaA__AFJ75452

SEQ ID NO: 205262 - RNA, 1410 nt, Artificial Sequence; identical to SEQ ID NO: 198908
  derived and/or modified sequence opt5 from neuraminidase__InfluenzaA__AFJ75463

SEQ ID NO: 205263 - RNA, 1413 nt, Artificial Sequence; identical to SEQ ID NO: 205259
  derived and/or modified sequence opt5 from neuraminidase__InfluenzaA__AFJ75552

SEQ ID NO: 205264 - RNA, 1413 nt, Artificial Sequence
  derived and/or modified sequence opt5 from neuraminidase__InfluenzaA__AFJ75574
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggcgggcaauucuagccuuuguuccauuagcgggugggcuauccauaccaaagauaacucuauucggaucggauccaagggcgacgucuucgugauucgcgagccguuuaucagcugcucucaccuggaguguaaaacguucuuucucacccaaggcgcccugcuuaaugauaagcauuccaacgggacaguuaaggacagaagccccuaccgggcccugaugucuugcccucucggagaagcucccuccccuuauaauagcaaauucgaguccguggccuggucugcuagcgccugucacgauggcaucggguggcugaccauuggaaucuccggccccgacaacggggcggucgccgugcugaaguacaacggaauuaucacaggcaccauuaaaagcuggaagggccagauccuccgcacgcaggaaucugagugcguuuguaugaauggguccugcuuuacaaucaugaccgauggaccuagcaacggcgcugccucuuauaaaauuuucaagaucgagaaggggaaagugacaaagagcauggaacugaaugcuccgaacuuucacuacgaggaauguuccugcuaucccgacaccggaaccgucaugugugugugcagagauaauuggcauggcucuaaccggccuugggugagcuucaaucagaaccuugacuaccaaauuggguacaucugcuccggagucuuuggcgauaauccccgcccugaggacggcgaggggagcuguaaccccguuacaguggauggagccaauggcgugaaaggguucucuuauaaguacggaaacggcgucuggauugggagaacgaaauccaaucggauccgcaagggcuuugaaaugauuugggacccgaacggauggaccaauacagacagcgauuucucugugaaacaggacaucguugcgaucaccgauugguccggcuauagcggguccuuugugcagcacccugagcugacaggacucgacugcauuagacccuguuucugggucgaacuggugcggggccuuccucgcgagaacaccacgaucuggacaucugggagcuccauuucuuucugcggaguuaacagcgauaucgccaauugguccuggcccgacggcgcugaacugcccuuuaccauugauaaguga

SEQ ID NO: 205265 - RNA, 1410 nt, Artificial Sequence; identical to SEQ ID NO: 198908
  derived and/or modified sequence opt5 from neuraminidase__InfluenzaA__AFJ75585

SEQ ID NO: 205266 - RNA, 1410 nt, Artificial Sequence
  derived and/or modified sequence opt5 from neuraminidase__InfluenzaA__AFJ75596
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugggaucacaggauucgccccuuuuucuaaagacaacagcauucgccuguccgcgggcggggauaucugggugaccagagagcccuaugucucuugcgacccugauaaguguuaccaauucgcucuuggacagggcacaacccugaauaacgugcauagcaauaacacgguucgggaccgcacaccguauagaacccuccugaugaaugaacugggggugcccuuucaccucggaacaaagcaggucugcaucgccugguccucuagcuccugucaugauggcaaagccuggcugcacgugugcauuaccggcgacgauaagaacgcuaccgccagcuucaucuacaaugggcggcuuguugacucuauuguguccuggagcaaagagauccugcgcacacaggaaucugagugugucugcauuaacggaacguguaccguggugaugacagauggcuccgcuagcgggaaggccgacaccaaaauccucuuuaucgaggaaggaaagauuguccauacauccacccugucuggcagcgcgcaacacguugaggaaugcuccugcuauccuagauaccccggggugcggugugugugccgcgauaacuggaagggaagcaauagaccuaucgucgacauuaacaucaaagaucacucuauuguguccagcuacguuuguucuggccuugugggcgacacgccccggaagaaugacagcuccucuagcucccauugccuggauccgaacaaugaggaagggggacacggcgucaaagggugggccuucgacgauggaaacgacguguggaugggccgcacaaucagcgagaagucuagacucggguaugagaccuuuaaaguuaucgaaggaugguccaauccuaagagcaaacugcagauuaaccgccaggugaucgucgaucggggcaauagaucuggcuacuccgggauuuucagcguggagggaaaguccuguaucaaccggugcuuuuaugucgaacugauuagaggccgcaaggaggaaaccgaggugcucuggacaucuaauagcaucguuguguucugugggaccuccggaacauacggcacggggucuuggcccgacggcgcugauauuaaccugaugccuaucuga

SEQ ID NO: 205267 - RNA, 1410 nt, Artificial Sequence
  derived and/or modified sequence opt5 from neuraminidase__InfluenzaA__AFJ75607
augaaccccacccagaagaucauuacaaucggcagcgugucccugacgauuucuaccaucugcuucuuuaugcaaacagccauucucaucaccacagucacccugcacuucaaacaguacgaguuuaauagcccuccgaacaaucagguuaugcuuugugaacccacaaucauugagagaaacaucaccgaaauuguguaucugacgaauaccacaaucgagaaggaaauuugcccuaaacucgcugaguaccggaacugguccaagccccagugugacaucaccggguucgccccuuuuucuaaagauaauagcauucgccuguccgcgggaggcgacaucugggugacaagagagcccuaugucucuugcgauccugaaaaguguuaccaauucgcucuugggcagggaaccacgcugaacaaugugcauagcaacaauacaguucgggaccgcaccccguauagaacacuccugaugaacgagcugggcgugcccuuucaccucgggaccaagcaggucugcaucgccugguccucuagcuccugucaugauggaaaagccuggcugcacgugugcauuaccggcgacgauaagaaugcuacagccagcuucaucuacaacggccggcuuguugacucuauuguguccuggagcaaagaaauccugcgcacgcaggagucugagugugucugcauuaaugggaccuguacaguggugaugaccgauggauccgcuagcggcaaggccgacacaaaaauccucuuuaucgaagaggggaagauuguccauaccuccaagcugucuggaagcgcgcaacacguugaagagugcuccugcuauccuagauaccccggcgugcggugugugugccgcgauaacuggaaagggagcaacagaccuaucgucgacauuaauaucaaggaucacucuauuguguccagcuacguuuguucuggacuugugggcgacacgccccggaaaaacgacagcuccggcucuagccauugccuggauccgaauaacgaagaagggggacacggcgucaaggggugggccuucgacgauggaaaugacguguggaugggccgcacaaucuccgagaaaagcagacucggguaugagaccuuuaagguuaucgagggauggucuaacccuaaauccaagcugcagauuaaucgccaggugaucgucgaucggggcaacagaagcggcuacucugggauuuucuccguggaaggaaagagcuguaucaaucggugcuuuuaugucgagcugauuagaggccgcaaagaagagaccgaggugcucuggacauccaacucuaucguuguguucugugggaccagcggaacauacggcacgggguccuggcccgacggcgcugauauuaaucugaugccuaucuga

SEQ ID NO: 205268 - RNA, 1410 nt, Artificial Sequence
  derived and/or modified sequence opt5 from neuraminidase__InfluenzaA__AFJ75633
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagauauccugcgcacccaggagucugaaugugugugcauuaaugggacauguacgguggucaugaccgacggauccgcuagcggcaaggccgauacaaaaauccucuuuaucgaggaggggaagauuguucauaccuccacacugucuggaagcgcgcaacacguggaagagugcuccugcuauccuagauaccccggcgugcggugugucugccgcgacaacuggaaggggagcaacagaccuaucguggacauuaauaucaaaaaccacucuauuguuuccagcuacguguguucuggacuugucggcgauacgccccggaagaaugacagcuccucuagcucccauugccuggauccgaacaaugaagagggcgggcacggagugaaaggcugggccuucgacgaugggaacgacguuuggaugggacgcaccaucagcgaaaagucuagacucggcuaugagacauuuaaagugaucgaggggugguccaauccuaagagcaaacugcagauuaaccggcaggucaucguggaucgcggaaauagaucuggcuacuccggcauuuucagcgucgaagggaaguccuguaucaaccggugcuuuuauguggagcugauuagaggacgcaaggaagagaccgaaguucucuggaccucuaauagcaucguggucuucuguggcacauccgggaccuacggaacaggcucuuggcccgacggggcugauauuaaccugaugccuaucuga

SEQ ID NO: 205269 - RNA, 1413 nt, Artificial Sequence; identical to SEQ ID NO: 200485
  derived and/or modified sequence opt5 from neuraminidase__InfluenzaA__AFJ75654

SEQ ID NO: 205270 - RNA, 1410 nt, Artificial Sequence; identical to SEQ ID NO: 198908
  derived and/or modified sequence opt5 from neuraminidase__InfluenzaA__AFJ75665

SEQ ID NO: 205271 - RNA, 1413 nt, Artificial Sequence
  derived and/or modified sequence opt5 from neuraminidase__InfluenzaA__AFJ75676
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggcgggcaauucuagccuuuguuccauuagcgggugggcuauccauaccaaagauaacucuauucggaucggauccaagggcgacgucuucgugauucgcgagccguuuaucagcugcucucaccuggaguguaaaacguucuuucucacccaaggcgcccugcuuaaugauaagcauuccaacgggacaguuaaggacagaagccccuaccgggcccugaugucuugcccucucggagaagcucccuccccuuauaauagcaaauucgaguccguggccuggucugcuagcgccugucacgauggcaucggguggcugaccauuggaaucuccggccccgacaacggggcggucgccgugcugaaguacaacggaauuaucacaggcaccauuaaaagcuggaagaaacagauccuccgcacgcaggaaucugagugcguuuguaugaauggcuccugcuuuacaaucaugaccgaugggccuagcaacggagcugccucuuauaagauuuucaagaucgagaaaggcaaggugacaaaaagcauggaacugaaugcuccgaacuuucacuacgaggaauguuccugcuaucccgacaccgggaccgucaugugugugugcagagauaauuggcauggaucuaaccggccuugggugagcuucaaucagaaccuugacuaccaaauuggcuacaucugcuccggggucuuuggagauaauccccgcccuaaggacggcgagggcagcuguaaccccguuacaguggauggggccaauggagugaaaggcuucucuuauaaguacgggaacggagucuggauuggcagaacgaaauccaaucggauccgcaagggguuugagaugauuugggacccgaacggcuggaccaauacagacagcgauuucucugugaagcaggacaucguugcgaucaccgauugguccggauauagcggcuccuuugugcagcacccugaacugacagggcucgacugcauuagacccuguuucugggucgagcuggugcggggacuuccucgcgaaaacaccacgaucuggacaucuggcagcuccauuucuuucugcgggguuaacagcgauaucgccaauugguccuggcccgacggagcugagcugcccuuuaccauugauaaauga

SEQ ID NO: 205272 - RNA, 1413 nt, Artificial Sequence; identical to SEQ ID NO: 200485
  derived and/or modified sequence opt5 from neuraminidase__InfluenzaA__AFJ75687

SEQ ID NO: 205273 - RNA, 1410 nt, Artificial Sequence; identical to SEQ ID NO: 199762
  derived and/or modified sequence opt5 from neuraminidase__InfluenzaA__AFJ76122

SEQ ID NO: 205274 - RNA, 1410 nt, Artificial Sequence; identical to SEQ ID NO: 204340
  derived and/or modified sequence opt5 from neuraminidase__InfluenzaA__AFJ76134

SEQ ID NO: 205275 - RNA, 1410 nt, Artificial Sequence; identical to SEQ ID NO: 199762
  derived and/or modified sequence opt5 from neuraminidase__InfluenzaA__AFJ76146

SEQ ID NO: 205276 - RNA, 1410 nt, Artificial Sequence; identical to SEQ ID NO: 199762
  derived and/or modified sequence opt5 from neuraminidase__InfluenzaA__AFJ76159

SEQ ID NO: 205277 - RNA, 1410 nt, Artificial Sequence; identical to SEQ ID NO: 199762
  derived and/or modified sequence opt5 from neuraminidase__InfluenzaA__AFJ76173

SEQ ID NO: 205278 - RNA, 1410 nt, Artificial Sequence; identical to SEQ ID NO: 199762
  derived and/or modified sequence opt5 from neuraminidase__InfluenzaA__AFJ76191

SEQ ID NO: 205279 - RNA, 1413 nt, Artificial Sequence
  derived and/or modified sequence opt5 from neuraminidase__InfluenzaA__AFJ76192
augaaccccaaucagaagaucauuaccaucggcagcauuuccaucgccauugggaucaucucucugauggugcaaauuggaaacaucauuagcaucugggcuucccacucuauucagacaggcauccagaauaacacggggauuugcaaucagagaaucaucaccuacgagaacagcacaugggucaaucauaccuauguuaacauuaauaacacaaaugugguggccggagaagacaaaaccuccgucacacucgcgggcaacucuagccuguguuccaucagcgggugggcuauuuacaccaaggauaauucuauccggauuggauccaaaggcgacguguucguuauccgcgagccuuuuaucagcugcucucaccuugaauguagaacguucuuucugacccaaggcgcccuccugaacgauaagcauuccaaugggacagugaaagaccggagcccguaucgcgcccuuaugucuugcccccugggagaggcuccuucccccuacaacagcaaguucgaauccgucgccuggucugcuagcgccugucacgauggcaugggguggcucaccauuggaaucuccggcccugacaacggggcgguggccguucugaaguauaauggaauuaucacaggcaccauuaaaagcuggaagaaacagauccugagaacgcaggagucugagugcguguguaugaacggcuccugcuuuacaaucaugaccgaugggcccagcaauaaggcugccucuuacaaaauuuucaagaucgaaaagggaaaagucacaaagagcauugagcucaacgcuccuaauuuuuauuacgaagaguguuccugcuacccggacaccggcaucgugaugugugugugccgggauaacuggcaugggucuaaucgccccugggucagcuucaaccagaaucuggacuaucaaauuggauacaucugcuccggcguuuuuggggauaacccuagacccgaggacggagaaggcagcuguaauccugugaccguggauggcgccaacggggucaaaggauucucuuauaaguacggcaaugggguguggauuggacggacaaaauccaaccgccuuagaaagggcuuugagaugaucugggaccccaauggguggacgaacaccgacagcgauuucucuguuaaacaggacguggucgcgaucacagauugguccggcuauagcggauccuuugugcagcacccggaacugaccggccucgacugcauucggccuuguuucuggguugagcuggugcgcgggcuucccagagaaaacacaaccaucuggacgucuggaagcuccauuucuuucugcggcgucaauagcgauacagccaacugguccuggccugacggggcugagcugcccuuuaccaucgauaaguga

SEQ ID NO: 205280 - RNA, 1410 nt, Artificial Sequence; identical to SEQ ID NO: 199762
  derived and/or modified sequence opt5 from neuraminidase__InfluenzaA__AFJ76206

SEQ ID NO: 205281 - RNA, 1410 nt, Artificial Sequence
  derived and/or modified sequence opt5 from neuraminidase__InfluenzaA__AFJ76216
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauuaagagaaauaucaccgagauuguguaccucacaaacaccacgaucgaaaaagagauuuguccuaagcuggccgaauaucggaauuggagcaaaccccagugcaacaucaccggguucgcgccuuuuuccaaggacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugagcucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaagagggcaagaucguccacauuagcacccuuuccgggucugcccaacauguugaggaaugcagcuguuacccuagauaucccggagugcggugcgugugucgcgacaacuggaaaggcuccaauagaccuaucgucgauauuaacgugaaggacuacagcaucguuucuuccuacgugugcagcggccuggucggggacacaccccggaaaaaugauucuuucagcuccucucacugucucgacccgaacaaugaggaaggaggccauggggugaagggaugggcuuuugaugacggcaacgauguuuggauggggcgcaccauuagcgagaaacugagauccggauaugaaacguucaaggugaucgagggcuggagcaaaccuaauucuaagcugcagaucaaccggcaggucauuguggagcgcggcaauagauccggguacagcggaaucuuuucugucgaaggcaaguccugcauuaaccgguguuucuauguggagcucaucagagggcgcaaagaagagacagaaguuugguggaccagcaauuccauuguggucuuuugcggaaccucuggcacauacgggaccggcagcuggcccgacggagccgauaucaaccugaugccuauuuga

SEQ ID NO: 205282 - RNA, 1410 nt, Artificial Sequence
  derived and/or modified sequence opt5 from neuraminidase__InfluenzaA__AFJ77411
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaaaaucaccggguucgccccuuuuuccaaggacaacucuauucgccuuagcgcgggaggcgauaucugggugacaagagagcccuauguuuccugugacccugggaagugcuaccaauucgcucugggacagggcaccacacucaauaaccggcauucuaaugauaccgugcacgaccgcacgccguauagaacacugcugaugaacgaacucgggguccccuuucaucugggaaccaaacagguguguaucgccuggagcuccagcucuugccacgauggcaaggccuggcuucauguuugugugacaggccacgacgagaaugcuaccgccuccuucauuuacgaugggcggcuggucgacagcaucggaucuugguccaaaaacauucuccgcacccaggaaagcgagugcguguguaucaauggcacaugcacgguggucaugaccgaugggucugcuuccgagagagccgacacaaagauucuguuuaucgaagagggaaaaaucguucacauuagcccucuuuccggcucugcgcaacauguggaagagugcagcuguuauccccgguacccuggggugcgcugcgucuguagagauaacuggaagggauccaaccggcccaucguggacauuaauguuaaggauuacagcaucgugucuuccuaugucugcagcggccuggugggcgacaccccgcgcaaaaacgacucuagcuccucuagcuacugucucaauccuaacaaugaagaagggggacacggcguuaaggggugggccuucgaugacggaaacgauguguggaugggcagaacaauuuccgagaaacugcggagcggguaugagaccuuuaaggucaucggaggcuggucuaaacccaauuccaagcugcagaucaaccgccaggugauugucgacagaggcaaucggagcggguacucuggaaucuucuccguggagggcaaaagcugcguuaacagauguuuuuauguggaacucauucgcgggcggaagcaggagacggaagucugguggacauccaauucuaucgugguuuucugcggaaccagcggcaccuacgggacaggcuccuggccugauggagcugacauuaaccugaugcccaucuga

SEQ ID NO: 205283 - RNA, 1410 nt, Artificial Sequence
  derived and/or modified sequence opt5 from neuraminidase__InfluenzaA__AFJ77422
augaaccccaaucagaagaucauuaccaucggcagcgugucccugacaauugccacgaucugcuuccucaugcaaauugcuauccuggucaucaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugauaagugcuaccaauucgcccuggggcagggaacaacccucaauaaccggcauucuaaugacacaguucacgaucgcaccccguauagaacgcugcugaugaacgaacucggcgugcccuuucaucuggggacaaaacaggucuguauugccuggagcuccagcucuugccacgacggaaaggcuuggcuucauguguguguuaccggccacgaugagaaugccacagcuuccuucaucuacgacggccggcugguggauagcauugggucuugguccaaaaagauccuccgcacccaggaaagcgagugcgucuguauuaacggaaccugcacaguggugaugacggacggcucugccuccgggagagcggauaccaaaauccuguuuaucgaggaaggaaagauuguccacaucagcccucuuuccggcucugcccaacauguugaggaaugcagcuguuauccccgguacuccggggugcgcugcguguguagagacaauuggaagggaagcaaccggccuauugucgauaucaacgugaaagacuacucuauuguuuccagcuucgugugcucuggccuggucggcgacacaccccgcaagaaugauagcuccucuagcucccacugucucaacccgaauaacgaggaagggggacauggcgugaaagggugggcuuuugacgauggaaaugacguuuggaugggcagaaccaucagcgagaagcugcggucuggguaugagacauucaaagugaucggaggcugguccaagccuaacagcaaacugcagauuaaucgccaggucaucguggauagaggcaaccggucuggguacuccggaauuuuuagcgucgaaggcaaguccugcaucaauagauguuucuauguggagcucauucgcgggcggaagcaggaaaccgagguuugguggacgucuaacagcaucguggucuuuugcggaacauccggcaccuacgggaccggcucuuggcccgacggagccgauauuaaucugaugccuaucuga

SEQ ID NO: 205284 - RNA, 1410 nt, Artificial Sequence
  derived and/or modified sequence opt5 from neuraminidase__InfluenzaA__AFJ77433
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaaaaucaccggguucgccccuuuuuccaaggacaacucuauucgccuuagcgcgggaggcgauaucugggugacaagagagcccuauguuuccugugacccugggaagugcuaccaauucgcucugggacagggcaccacacucaauaaccggcauucuaaugauaccgugcacgaccgcacgccguauagaacacugcugaugaacgaacucgggguccccuuucaucugggaaccaaacagguguguaucgccuggagcuccagcucuugccacgauggcaaggccuggcuucauguuugugugacaggccacgacgagaaugcuaccgccuccuucauuuacgaugggcggcuggucgacagcaucggaucuugguccaaaaacauucuccgcacccaggaaagcgagugcguguguaucaauggcacaugcacgguggucaugaccgaugggucugcuuccgagagagccgacacaaagauucuguuuaucgaagagggaaaaaucguucacauuagcccucuuuccggcucugcgcaacauguggaagagugcagcuguuauccccgguacccuggggugcgcugcgucuguagagauaacuggaagggauccaaccggcccaucguggacauuaauguuaaggauuacagcaucgugucuuccuaugucugcagcggccuggugggcgacaccccgcgcaaaacagacucuagcuccucuagcgauugucucaacccuaauaacgaagaagggggacacggcguuaaggggugggccuucgacgauggaaaugacguguggaugggcagaaccauuuccgagaaacugcggagcggguacgagacguuuaaggucaucggaggcuggucuaaacccaacuccaagcugcagaucaaucgccaggugauugucgauagaggcaaccggagcggguauucuggaaucuucuccguggagggcaaaagcugcguuaauagauguuuuuacguggaacucauucgcgggcggaagcaggagacagaagucugguggaccuccaacucuaucgugguuuucugcggaaccagcggcacauaugggaccggcuccuggccugacggagcugauauuaaucugaugcccaucuga

SEQ ID NO: 205285 - RNA, 1410 nt, Artificial Sequence
  derived and/or modified sequence opt5 from neuraminidase__InfluenzaA__AFJ77443
augaaccccaaucagaagaucauuaccaucggcagcgugucccugacaauugccacgaucugcuuccucaugcaaauugcuauccuggucaucacccuuacacugcacuuuaaacaguacgaguguaacucuccuccgaauaaccagguuaugcucugcgaacccaccauuaucgagagaaauauuacagaaaucguguaucugaccaacacaaccauugagaaggaaaucuguccuaaacuugccgaguaccggaauuggagcaagccccagugcaaaauuacgggguucgcgccuuuuuccaaggacaacucuauccgccugagcgcuggaggcgauaucugggugaccagagagcccuaugucuccugugacccugggaagugcuaccaauucgcccucggacagggcacaacccugaauaaccggcauucuaaugauacagugcacgaccgcaccccguauagaacgcugcucaugaacgaacuggggguucccuuucaucuuggaacaaaacagguguguauugccuggagcuccagcucuugccacgauggcaaggcuuggcugcaugucugugugaccggccacaaugagaacgccacagcuuccuucaucuacgacgggcggcucguugauagcauuggaucuugguccaaaaauauccugcgcacccaggaaagcgagugcguguguauuaacggaaccugcacagucgugaugacggacgggucugccuccggcagagcggauaccaagauccuuuuuaucgaggaaggcaaaauugugcacaucagcccucuguccgggucugcccaacaugucgaggaaugcagcuguuauccccgguacccuggaguucgcugcguguguagagacaacuggaagggcuccaaucggcccauuguggauaucaacgucaaggacuucagcauugugucuuccuacguuugcagcggccucgugggggauacaccgcgcaaaaaugacucuagcuccucuagccacugucugaacccuaauaacgaggaaggaggcaauggggucaagggaugggcuuuugacgauggcaacgacguguggauggggagaaccaucuccgagaaacugcggagcggauaugagacauucaagguuaucggcggcuggucuaaacccaauuccaagcuccagauuaaccgccaggugaucgucgauagagggaaucggagcggauacucuggcaucuuuuccguggaagggaaaagcugcauuaacagauguuucuaugucgagcugauucgcggacggaagcaggaaaccgaggugugguggacguccaauucuaucguuguguuuugcggcacaagcgggaccuacggcaccggauccuggccugacggcgccgauauuaaccuuaugcccaucuga

SEQ ID NO: 205286 - RNA, 1410 nt, Artificial Sequence
  derived and/or modified sequence opt5 from neuraminidase__InfluenzaA__AFJ77465
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaaaaucaccggguucgcgcccuuuagcaaggacaacuccauucgccuuucugcuggaggcgauaucugggucacaagagagccuuaugugagcugugacccggauaagugcuaccaauucgcccuggggcagggaaccacacucaauaaccggcauuccaaugacaccguucacgaucgcacgcccuauagaacacugcugaugaacgaacucggcgugccuuuucaucuggggaccaaacaggucuguaucgccuggucuagcuccagcugccacgacggaaaggcuuggcuucauguguguguuacaggccacgaugagaaugccaccgcuucuuucauuuacgacggccggcugguggauuccaucgggagcuggucuaaaaagauucuccgcacccaggaauccgagugcgucuguaucaacggaacaugcacgguggugaugaccgacggcagcgccucugggagagcggauacaaaaauucuguuuaucgaggaaggaaagaucguccacauuagcccccuuuccggcuccgcccaacauguugaggaaugcucuuguuauccucgguaccccggggugcgcugcguguguagagacaauuggaagggaagcaaccggccgaucgucgauauuaacgugaaaaauuacuccaucguuagcucuuaugugugcuccggccuggucggcgacaccccucgcaagaacgacagcucuagcuccucucacugucucaaucccaacaaugaggaagggggacauggcgugaaagggugggcuuucgaugacggaaacgauguuuggaugggcagaacaauuagcgagaagcugcgguccggguacgagaccuuuaaagugaucgaaggauggagcaagccuaauucuaaacugcagaucaaccgccaggucauuguggacagaggcaaucgguccggcuauagcgggaucuucucugucgagggaaaguccugcauuaacagauguuuuuacguggaacucauccgcggccggaagcaggagacggaaguuugguggacaagcaauuccauuguggucuucugcgggaccucuggaaccuauggcacagggagcuggcccgauggcgccgacaucaaccugaugcccauuuga

SEQ ID NO: 205287 - RNA, 1410 nt, Artificial Sequence
  derived and/or modified sequence opt5 from neuraminidase__InfluenzaA__AFJ77476
augaaccccaaucagaagaucauuaccaucggcagcguuucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacggcgggcggcucguggacagcaucggaucuugguccaaaaagauucugcgcacccaggaaagcgagugcgucuguaucaacggcacaugcacgguggugaugaccgaugggucugccuccggcagagcggacacaaaaauucuuuuuaucgaggaaggaaagaucauucacaucagccaacuguccgggucugcccagcaugucgaggaaugcagcuguuauccccgguacccuggaguucgcugcguguguagagauaauuggaagggcuccaaccggcccauuguggacaucaacgucaaagauuacagcauugugucuuccuauguuugcagcggccucgugggggacaccccucgcaagaaugacucuagcuccucuagccacugucuggaucccaacaaugaggaaggaggccauggggucaaaggaugggcuuucgacgauggcaacgacguguggauggggagaacaaucuccgagaaguuucggagcggauacgagaccuucaaaguuaucgaaggcuggucuaagccuaauuccaaacugcagauuaaccgccagaucauuguggauagagacaaucggagcggcuauucugggaucuuuuccgucgagggaaagagcugcauuaacagauguuucuacguggaacucauccgcggccggaagcaagagacggaagucugguggacauccaauucuauugugguguuuugcgggaccagcggaaccuauggcacaggguccuggccggauggcgccgacaucaaccugaugcccaucuga

SEQ ID NO: 205288 - RNA, 1410 nt, Artificial Sequence; identical to SEQ ID NO: 197339
  derived and/or modified sequence opt5 from neuraminidase__InfluenzaA__AFJ77487

SEQ ID NO: 205289 - RNA, 1410 nt, Artificial Sequence
  derived and/or modified sequence opt5 from neuraminidase__InfluenzaA__AFJ77498
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacaccagcaaacuuuccggcucugcccaacauguugaggaaugcagcuguuauccucgguaccccggggugcgcugcguguguagagacaauuggaagggauccaaccggccuauugucgauaucaacgugaaggacuacagcauuaucucuuccuauguuugcagcggccuggugggcgacacaccccgcaaaaaugauucuagcuccucuagccacugucucgacccgaacaaugaggaagggggacauggcgucaaggggugggcuuucgaugacggaaacgauguguggaugggcagaaccauuuccgagaaaagccggucuggguacgagacguuuaagguuaucgaaggaugguccaaaccuaauagcaagcugcagaucaaccgccaggugauugucgagagaggcaauaugucuggcuauuccgggaucuucagcguggaaggaaaguccugcauuaaccgguguuuuuacgucgagcugaucagaggccgcaaacaggaaacagaggugugguggaccucuaauagcauuguuguguucugcgggaccuccggaacauauggcaccgggucuuggcccgacggcgccgauaucaaccucaugccuauuuga

SEQ ID NO: 205290 - RNA, 1410 nt, Artificial Sequence; identical to SEQ ID NO: 197339
  derived and/or modified sequence opt5 from neuraminidase__InfluenzaA__AFJ77509

SEQ ID NO: 205291 - RNA, 1410 nt, Artificial Sequence
  derived and/or modified sequence opt5 from neuraminidase__InfluenzaA__AFJ77520
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaucaacagacaggucaucguggaccggggcaaucgcucuggguauuccggaauuuucagcgucgagggcaaguccugcaucaacagauguuuuuacguggaacucauucgggggagaaagcaggagaucgaaguucuguggacaucuaauagcauuguggucuucugcggaaccuccggcaccuaugggacaggcucuuggcccgauggagccgacaucaaccuuaugccuauuuga

SEQ ID NO: 205292 - RNA, 1410 nt, Artificial Sequence
  derived and/or modified sequence opt5 from neuraminidase__InfluenzaA__AFJ77531
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaagucaccggguucgccccuuuuuccaaggacaacucuauucgccuuagcgcgggaggcgauaucugggugacaagagagcccuacguuuccugcgacccugggaaguguuaucaauucgcucugggacagggcaccacacucaauaaccggcauucuaaugauaccgugcacgaccgcacgccguacagaacacugcugaugaacgaacucgggguccccuuucaucugggaaccaaacaggugugcaucgccuggagcuccagcucuugucacgauggcaaggccuggcuucauguuugcgugacaggccacaaugagaacgcuaccgccuccuucauuuaugacgggcggcuggucgauagcaucggaucuugguccaaaaauauucuccgcacccaggaaagcgagugugugugcaucaacggcacaugcacgguggucaugaccgacgggucugcuuccggcagagccgauacaaagauucuguuuaucgaggaaggaaaaaucguucacauuagcccucuuuccgggucugcgcaacauguggaggaauguagcugcuacccccgguauccuggagugcgcugugucugcagagacaacuggaagggcuccaaucggcccaucguggauauuaacguuaaggacuacagcaucgugucuuccuacgucuguagcggccuggugggggauaccccgcgcaaaaaugacucuagcuccucuagcuauugccucgacccuaacaaugaggaaggaggccacgggguuaagggaugggccuucgaugacggcaacgauguguggauggggagaacaauuuccgagaaacugcggagcggauacgagaccuuuaaggucaucggcggcuggucuaaacccaauuccaagcugcagaucaaccgccaggugauugucgacagagggaaucggagcggauauucuggcaucuucuccguggaagggaaaagcuguauuaacagaugcuuuuacguugagcucauccgcggacggaagcaggaaacggaggugugguggacauccaauucuauugucguguucuguggcaccagcgggaccuauggcacaggauccuggccugauggcgcugacaucaaccugaugcccauuuga

SEQ ID NO: 205293 - RNA, 1410 nt, Artificial Sequence
  derived and/or modified sequence opt5 from neuraminidase__InfluenzaA__AFJ77542
augaaccccaaucagaagaucauuaccaucggcagcgugucccugacaauuucuacgaucugcuuccucaugcaaauugccauccuggucaccacaguuacccuucacuuuaaacaguacgaguguaacagcccuccgaauaaccaggugaugcugugcgaacccacaaucauugagagaaauaucaccgaaauuguguaucucacaaacaccacgaucgagaaggaaauuuguccuaaacuggcugaguaccggaauugguccaagccccagugcaacaucaccggguucgccccuuuuucuaaagacaauagcauucgccuuuccgcgggaggcgauaucugggucacaagagagcccuaugugucuugugacccugauaagugcuaccaauucgcucuggggcagggaaccacacucaacaauggccauagcaacgacaccguucacgaucggacgccguaucgcacacugcugaugaaugaacucggggugcccuuucaucugggaaccaagcaggucuguaucgccugguccucuagcuccugccacgacggcaaagccuggcuucauguguguguuacaggcgaugacgagaacgcuaccgccagcuucauuuacaaugggagacugguggauucuaucggauccuggagcaagaaaauucuccggacccaggaaucugagugcgucuguaucaacggcacaugcacgguggugaugaccgacggguccgcuagcggaaaggccgauacaaaaauucuguuuaucgaggaaggcaagaucguccacaccuccacacuuucugggagcgcgcaacacguugaggaaugcuccuguuauccucgcuaccccggagugagaugcgugugucgggacaacuggaagggcagcaaucgcccuauugucgauaucaacauuaaagacuacucuaucguguccagcuauguuugcucuggccuggugggggacacccccagaaagaaugauagcuccucuagcucccauugucucgacccgaacaaugaggaaggaggccacggggucaaaggaugggccuucgaugacggcaacgauguguggauggggcggacgauuagcgagaagcugcgcucuggauacgagacauuuaaaguuaucgaaggcugguccaagccuaauagcaaacugcagaucaacagacaggugauugucgaccggggcaaucgcucuggguauuccggaaucuucagcguggagggcaaguccugcauuaacagauguuuuuacgucgaacucauccgggggagaaagcaggagaccgaagugcuguggaccucuaauagcauuguuguguucugcggaacauccggcaccuaugggacaggcucuuggcccgauggagcugacaucaaccuuaugccuauuuga

SEQ ID NO: 205294 - RNA, 1410 nt, Artificial Sequence; identical to SEQ ID NO: 197277
  derived and/or modified sequence opt5 from neuraminidase__InfluenzaA__AFJ77553

SEQ ID NO: 205295 - RNA, 1410 nt, Artificial Sequence
  derived and/or modified sequence opt5 from neuraminidase__InfluenzaA__AFJ77564
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagccaacuuuccggcucugcccagcauguugaggaaugcagcuguuauccucgguaccccggggugcgcugcguguguagagacaauuggaagggauccaaccggccuaucgucgauauuaacgugaaagacuacagcaucguuucuuccuaugugugcagcggccuggucggcgacacaccccgcaagaaugauucuagcuccucuagccacugucucaacccgaauaacgaggaagggggacauggcgugaaagggugggcuuucgacgauggaaaugacguuuggaugggcagaaccauuuccgagaagcugcggagcggguacgagaccuuuaaagugaucgaaggauggucuaagccuaacuccaaacugcagaucaaucgccaggucauuguggauagaggcaaccggagcggcuauucugggaucuucuccgucgagggaaagagcugcauuaauagauguuuuuacguggaacucauccgcggccggaagcaagagaacgaaguuugguggacguccaauucuauuguggucuucugcgggacaagcggaaccuauggcaccggguccuggcccgacggcgccgauaucaaccugaugccuauuuga

SEQ ID NO: 205296 - RNA, 1329 nt, Artificial Sequence
  derived and/or modified sequence opt5 from neuraminidase__InfluenzaA__AFJ77575
augaaccccaaucagaagaucauuaccaucggcagcguuucccugacaauugccacgaucugcuuccucaugcaaauugcuauccuggucaucgagagaaacauuaccgaaaucguuuaccuuacaaauaccacaauugagaaagaaaucuguccuaagcuggccgaguaucggaacuggucuaaaccgcagugcaauauuaccggguuugcgcccuucagcaaggacaacuccauccgccucucugcuggaggcgauauuugggugacaagagaaccuuacgugagcugugaccccgauaaaugcuaucaguuugcccuggggcagggaaccacgcuuaauaacggccacuccaaugacaccguccaugaucggacaccuuaccgcacccugcucaugaacgagcugggggugcccuuccaccugggaacaaagcaaguuuguaucgccuggucuagcuccagcugccaugacggcaaggcuuggcuccacgugugugucaccggcgaugacgagaaugccacggcuucuuuuaucuauaacgggagacugguggauuccauuggaagcuggucuaaaaagauccuucggacacaggaauccgagugcguuuguauuaaugggaccugcacaguggucaugaccgacggcagcgccucuggaaaagcggauaccaagauccuguucauugaagagggcaaaaucgugcauacauccagccucuccgggucugcccagcacguggaggaauguagcugcuacccucgcuauccgggagucagaugcguuugucgggacaacuggaagggcuccaaucgccccaucguggauauuaacgugaaggacuacagcaucgucucuuccuacgugugcagcggccugguuggggacacgccucggaaaaacgauucuagcuccucuagccacugucuugaccccaauaacgaggaaggaggccauggggugaagggaugggcuuuugaugacggcaaugaugucuggauggggagaaccauuuccgagaaacugcgcagcggauaugaaacauucaaggugaucgagggcuggucuaaaccuaacuccaagcuccagauuaauagacaaguuaucguggaccggggcaaccgcagcggguacucuggaaucuuuuccgucgagggcaaaagcugcauuaauagauguuucuauguggaacugauccgggggagaaagcaggagaccgaaguccuguggacauccaacucuauugugguguuuugcggaaccagcggcacguacgggacaggcuccuggcccgauggagccgacaucaaucucaugccgauuuga

SEQ ID NO: 205297 - RNA, 1410 nt, Artificial Sequence
  derived and/or modified sequence opt5 from neuraminidase__InfluenzaA__AFJ77597
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacacccgcccucuuagcggguccgcccaacacguugaggaaugcucuuguuaucccagauacccuggagugcggugcgugugucgcgacaacuggaagggcagcaauagacccauugucgauaucaacgugaaagacuacuccauuguuagcucuuaugugugcuccggccuggucggggacacaccgcggaagaaugauagcucuagcuccucucauugucucgacccuaacaaugaggaaggaggccacggggugaaaggaugggcuuucgaugacggcaacgauguuuggauggggcgcaccaucagcgagaagcugagauccggauacgagacguuuaaagugauugaaggcuggagcaagcccaauucuaaacugcagaucaaccggcaggucaucguggaccgcggcaauagauccggguauagcggaauuuucucugucgagggcaaguccugcaucaaccgguguuuuuacguggaacucauuagagggcgcaagcaggagacagaaguucuguggaccagcaauuccaucguggucuucugcggaaccucuggcacauaugggaccggcagcuggccugauggagccgacauuaaccuuaugcccaucuga

SEQ ID NO: 205298 - RNA, 1410 nt, Artificial Sequence
  derived and/or modified sequence opt5 from neuraminidase__InfluenzaA__AFJ77608
augaaccccaaucagaagaucauuaccaucggcagcgugucccugacaauugccacgaucugcuuccucaugcaaaccgcuauucuggucacaaccguuacacuucacuuuaaacaguacgaguguaacucuccuccgaauaaccaggugaugcugugcgaacccaccaucaucgagagaaauaugacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgaucugugggucaccagagagcccuauguguccugugacccugauaagugcuaccaauucgcccucgggcagggaacaacccugaacaauggccauucuaacgacacgguucacgaucggacaccguaucgcacccugcucaugaaugaacugggggugcccuuucaucuuggaacaaagcaggucuguaucgccuggagcuccagcucuugccacgacggcaaagccuggcugcauguguguguuaccggcgaugacgagaacgcuaccgcuuccuucauuuacaaugggagacucguggauagcaucggaucuugguccaagaaaauccugcggacacaggaaagcgagugcgucuguauuaacggcacgugcaccguggugaugacagacgggucugccuccggaaaggcggauaccaaaauccuuuuuauugaggaaggcaagaucguccacacaagcucccugucugggagcgcccaacacguugaggaaugcuccuguuauccucgcuaccccggagugagaugcgugugucgggacaacuggaagggcagcaaucgcccuauugucgauaucaacgugaaagacuacucuaucguuuccagcuaugugugcucuggccucgucggggacacccccagaaagaaugauagcuccucuagcucccauugucuggacccgaacaaugaggaaggaggccacggggugaaaggaugggcuuucgaugacggcaacgauguuuggauggggcggacgauuagcgagaagcugcgcucuggauacgagacauuuaaagugaucgaaggcugguccaagccuaauagcaaacuccagauuaacagacaggucaucguggaccggggcaaucgcucuggguauuccggaauuuucagcgucgagggcaaguccugcaucaacagauguuuuuacguggaacugauccgggggagaaagcaggagaccgaaguucuuuggaccucuaauagcauuguggucuucugcggaacauccggcaccuaugggacaggcucuuggcccgauggagccgacaucaaccugaugccuauuuga

SEQ ID NO: 205299 - RNA, 1410 nt, Artificial Sequence; identical to SEQ ID NO: 205297
  derived and/or modified sequence opt5 from neuraminidase__InfluenzaA__AFJ77619

SEQ ID NO: 205300 - RNA, 1410 nt, Artificial Sequence; identical to SEQ ID NO: 205297
  derived and/or modified sequence opt5 from neuraminidase__InfluenzaA__AFJ77630

SEQ ID NO: 205301 - RNA, 1410 nt, Artificial Sequence; identical to SEQ ID NO: 205293
  derived and/or modified sequence opt5 from neuraminidase__InfluenzaA__AFJ77641

SEQ ID NO: 205302 - RNA, 1410 nt, Artificial Sequence; identical to SEQ ID NO: 205293
  derived and/or modified sequence opt5 from neuraminidase__InfluenzaA__AFJ77652

SEQ ID NO: 205303 - RNA, 1410 nt, Artificial Sequence; identical to SEQ ID NO: 197064
  derived and/or modified sequence opt5 from neuraminidase__InfluenzaA__AFJ77663

SEQ ID NO: 205304 - RNA, 1410 nt, Artificial Sequence; identical to SEQ ID NO: 197064
  derived and/or modified sequence opt5 from neuraminidase__InfluenzaA__AFJ77674

SEQ ID NO: 205305 - RNA, 1410 nt, Artificial Sequence; identical to SEQ ID NO: 197064
  derived and/or modified sequence opt5 from neuraminidase__InfluenzaA__AFJ77685

SEQ ID NO: 205306 - RNA, 1410 nt, Artificial Sequence
  derived and/or modified sequence opt5 from neuraminidase__InfluenzaA__AFJ77696
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccgagaaggcggauacaaaaauucuguuuaucgaagagggaaagaucguccacaccagccuucuguccggcucugcccaacacguugaagagugcagcuguuauccucgcuaccccggggugagaugcgugugucgggacaacuggaagggauccaaucgcccuauugucgauaucaacgugaaagacuacagcauuguuucuuccuaugugugcagcggccucgucggcgacacacccagaaagaaugauucuagcuccucuagccauugucuggacccgaacaaugaagaagggggacacggcgugaaagggugggcuuucgaugacggaaacgauguuuggaugggccggaccaucuccgagaagcugcgcagcggguacgagacguuuaaagugauugagggauggucuaagccuaauuccaaacuccagaucaacagacaggucaucguggaccggggcaaucgcagcggcuauucugggauuuucuccgucgaaggaaagagcugcaucaacagauguuuuuacguggagcugauucggggcagaaagcaggaaacagagguucuuuggaccuccaauucuaucguggucuucugcgggaccagcggaacauauggcaccggguccuggcccgauggcgccgacauuaaccugaugccuaucuga

SEQ ID NO: 205307 - RNA, 1410 nt, Artificial Sequence; identical to SEQ ID NO: 197064
  derived and/or modified sequence opt5 from neuraminidase__InfluenzaA__AFJ77707

SEQ ID NO: 205308 - RNA, 1410 nt, Artificial Sequence; identical to SEQ ID NO: 197085
  derived and/or modified sequence opt5 from neuraminidase__InfluenzaA__AFJ77718

SEQ ID NO: 205309 - RNA, 1410 nt, Artificial Sequence; identical to SEQ ID NO: 197085
  derived and/or modified sequence opt5 from neuraminidase__InfluenzaA__AFJ77729

SEQ ID NO: 205310 - RNA, 1410 nt, Artificial Sequence
  derived and/or modified sequence opt5 from neuraminidase__InfluenzaA__AFJ77740
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguaucguggucaugacggacggauccgcuagcggcaaggccgauaccaaaauccucuuuauugaggaagggaagaucguucacacauccacccugucuggaagcgcgcaacacguggaggaaugcuccugcuauccucgcuaccccggcgugagaugugucugccgggacaacuggaaggggagcaaucgcccuauuguggauaucaacauuaaagacuacucuaucguuuccagcuauguguguucuggacuugucggcgacacacccagaaagaaugauagcuccucuagcucccauugccuggacccgaacaaugaggaaggcgggcacggagugaaaggcugggccuucgaugacgggaacgauguuuggaugggacggaccaucagcgagaagcuccgcucuggcuacgagacguuuaaagugauugaagggugguccaauccuaacagcaagcugcagaucaauagacaggucauuguggaccggggaaaccgcucuggcuauuccggcaucuucagcgucgaggggaaauccuguauuaauagaugcuuuuacguggaacugauccggggaagaaagcaggagacagaaguucucuggaccucuaacagcauuguggucuucuguggcaccuccgggacauauggaaccggcucuuggcccgauggggcugacaucaaucugaugccuaucuga

SEQ ID NO: 205311 - RNA, 1410 nt, Artificial Sequence
  derived and/or modified sequence opt5 from neuraminidase__InfluenzaA__AFJ77751
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucgggaucgcacgccguacagaacacugcugaugaaugaacucggggugcccuuucaucugggaacccggcaggucuguaucgccuggagcuccagcucuugccacgacggcaaggcuuggcuucauguguguguuacaggcgaugacaaaaacgccaccgcuuccuucauuuauaaugggcgccugguggauagcaucggaucuugguccaagaaaauucucagaacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacacguugaagagugcagcuguuacccucgguaucccggagugcgcugcguguguagagacaacuggaagggcuccaaucggccuaucgucgauauuaacgugaaagacuacagcaucuucucuuccuacguuugcagcggccuggugggggacacaccccgcaagaaugauucuuuuagcuccucucauugucucgacccgaacaaugaagagggaggccacggggucaaaggaugggcuuucgaugacggcaacgauguguggauggggagaaccauuagcgaaaagcugcgguccggauaugagacguuuaaaguuaucgagggcuggagcaagccuaauucuaaacugcagaucaaccgccaggugauugucgaaagaggcaaucgguccggguacagcggaaucuucucuguggagggcaaguccugcauuaacagauguuuuuaugucgaacucauccgcgggcggaaggaggaaacagaggugugguggaccagcaauuccauuguuguguucugcggaaccucuggcacauacgggaccggcagcuggcccgacggagccgauaucaaccugaugccuauuuga

SEQ ID NO: 205312 - RNA, 1410 nt, Artificial Sequence; identical to SEQ ID NO: 197169
  derived and/or modified sequence opt5 from neuraminidase__InfluenzaA__AFJ77762

SEQ ID NO: 205313 - RNA, 1410 nt, Artificial Sequence; identical to SEQ ID NO: 197169
  derived and/or modified sequence opt5 from neuraminidase__InfluenzaA__AFJ77773

SEQ ID NO: 205314 - RNA, 1410 nt, Artificial Sequence; identical to SEQ ID NO: 197169
  derived and/or modified sequence opt5 from neuraminidase__InfluenzaA__AFJ77784

SEQ ID NO: 205315 - RNA, 1410 nt, Artificial Sequence; identical to SEQ ID NO: 197738
  derived and/or modified sequence opt5 from neuraminidase__InfluenzaA__AFJ77795

SEQ ID NO: 205316 - RNA, 1410 nt, Artificial Sequence; identical to SEQ ID NO: 197738
  derived and/or modified sequence opt5 from neuraminidase__InfluenzaA__AFJ77806

SEQ ID NO: 205317 - RNA, 1410 nt, Artificial Sequence; identical to SEQ ID NO: 197738
  derived and/or modified sequence opt5 from neuraminidase__InfluenzaA__AFJ77817

SEQ ID NO: 205318 - RNA, 1410 nt, Artificial Sequence; identical to SEQ ID NO: 197738
  derived and/or modified sequence opt5 from neuraminidase__InfluenzaA__AFJ77828

SEQ ID NO: 205319 - RNA, 1410 nt, Artificial Sequence
  derived and/or modified sequence opt5 from neuraminidase__InfluenzaA__AFJ77839
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuauccacaccuccacacugucuggaagcgcgcaacacguugaagagugcuccugcuauccucgcuaccccggcgugagaugugugugccgggauaacuggaaagggagcaaccgcccuauugucgacaucaauauuaaggacuacucuaucguguccagcuauguuuguucuggacuugugggcgauacccccagaaagaacgacagcuccucuagcucccauugccuggauccgaauaacgaagagggcgggcacggagucaaaggcugggccuucgacgaugggaaugacguguggaugggacggacgaucagcgaaaaacuccgcucuggcuacgagacauuuaagguuauugaggggugguccaacccuaauagcaaacugcagaucaacagacaggugauugucgaucggggaaaucgcucuggcuauuccggcaucuucagcguggaagggaaguccuguauuaacagaugcuuuuacgucgagcugauccggggaagaaaggaagagaccgaagugcucuggaccucuaauagcauuguuguguucuguggcacauccgggaccuauggaacaggcucuuggcccgacggggcugauaucaaccugaugccuaucuga

SEQ ID NO: 205320 - RNA, 1410 nt, Artificial Sequence
  derived and/or modified sequence opt5 from neuraminidase__InfluenzaA__AFJ77850
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcuaaguaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgagcugggcgugcccuuucaucucgggaccaaacaggucugcauugccugguccucuagcuccugucacgauggaaaggccuggcugcaugugugcguuacaggcgacgauaaaaaugcuaccgccagcuucaucuacaacggcagacuuguggacucuauugucuccuggagcaagaaaauccugcggacccaggaaucugagugugugugcauuaaugggacauguacgguggucaugaccgauggauccgcuagcggcaaggccgacacaaagauccucuuuaucgaagaggggaaaauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgaaacauuuaaagugaucgaggggugguccaacccuaauagcaagcugcagauuaacagacaggucaucguggaucggggaaaucgcucuggcuauuccggcauuuucagcgucgaggggaaguccuguaucaacagaugcuuuuacguggaacugauucggggaagaaaagaggaaaccgagguucucuggaccucuaauagcaucguggucuucuguggcacauccgggaccuauggaacaggcucuuggcccgacggggcugauauuaaccugaugccuaucuga

SEQ ID NO: 205321 - RNA, 1410 nt, Artificial Sequence; identical to SEQ ID NO: 197738
  derived and/or modified sequence opt5 from neuraminidase__InfluenzaA__AFJ77861

SEQ ID NO: 205322 - RNA, 1410 nt, Artificial Sequence; identical to SEQ ID NO: 197738
  derived and/or modified sequence opt5 from neuraminidase__InfluenzaA__AFJ77872

SEQ ID NO: 205323 - RNA, 1410 nt, Artificial Sequence; identical to SEQ ID NO: 198204
  derived and/or modified sequence opt5 from neuraminidase__InfluenzaA__AFJ77883

SEQ ID NO: 205324 - RNA, 1410 nt, Artificial Sequence; identical to SEQ ID NO: 197738
  derived and/or modified sequence opt5 from neuraminidase__InfluenzaA__AFJ77894

SEQ ID NO: 205325 - RNA, 1410 nt, Artificial Sequence; identical to SEQ ID NO: 197738
  derived and/or modified sequence opt5 from neuraminidase__InfluenzaA__AFJ77905

SEQ ID NO: 205326 - RNA, 1410 nt, Artificial Sequence
  derived and/or modified sequence opt5 from neuraminidase__InfluenzaA__AFJ77916
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagaccgaaguucucuggaccucuaauagcaucauuguguucuguggcacauccgggaccuauggaacaggcucuuggcccgacggggcugauaucaaccugaugccuaucuga

SEQ ID NO: 205327 - RNA, 1410 nt, Artificial Sequence; identical to SEQ ID NO: 197760
  derived and/or modified sequence opt5 from neuraminidase__InfluenzaA__AFJ77927

SEQ ID NO: 205328 - RNA, 1410 nt, Artificial Sequence; identical to SEQ ID NO: 197760
  derived and/or modified sequence opt5 from neuraminidase__InfluenzaA__AFJ77938

SEQ ID NO: 205329 - RNA, 1410 nt, Artificial Sequence; identical to SEQ ID NO: 197738
  derived and/or modified sequence opt5 from neuraminidase__InfluenzaA__AFJ77949

SEQ ID NO: 205330 - RNA, 1410 nt, Artificial Sequence; identical to SEQ ID NO: 197738
  derived and/or modified sequence opt5 from neuraminidase__InfluenzaA__AFJ77960

SEQ ID NO: 205331 - RNA, 1410 nt, Artificial Sequence
  derived and/or modified sequence opt5 from neuraminidase__InfluenzaA__AFJ77971
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaugagaccgaaguucucuggaccucuaacagcaucguggucuucuguggcacauccgggaccuauggaacaggcucuuggcccgacggggcugauauuaaucugaugccuaucuga

SEQ ID NO: 205332 - RNA, 1410 nt, Artificial Sequence
  derived and/or modified sequence opt5 from neuraminidase__InfluenzaA__AFJ77982
augaaccccaaucagaagaucauuaccaucggcuucgugagccugacaauuuccacgaucugcuuuuucaugcaaauugccauccucaucaccacagucccucugcacuuuaaacaguacgaguucaacucuccgcccaauaaccagguuaugcuuugugaaccuaccauuaucgagagaaauauuacagaaaucguguaucugaccaacacaaccauugagaaggaaaucugccccaaacucgcugaguaccggaauuggagcaagccucaguguaacauuacgggguuugcccccuucuccaaagacaauucuauccgccugagcgcgggaggcgauaucugggugaccagagagccuuaugucuccugcgacccggauaaguguuaccaauuugcucuugggcagggaacaacccugaacaaugugcauucuaacgacacaguucacgaucggacccccuaucgcacgcuccugaugaaugaacugggcgugccuuuccaucucgggacaaagcaggucugcauugccuggagcuccagcucuugucacgacggaaaagccuggcugcaugugugcguuaccggcgaugacaagaacgcuacagccuccuuuaucuacaauggcagacuuguggauagcauugucucuugguccaaagagauccugcggacccaggaaagcgagugugugugcauuaacgggaccuguacaguggucaugacggacggaucugcuuccggcaaggccgauaccaaaauccucuucaucgaggaagggaagauuguucacacaagcacccuguccggaucugcgcaacacguggaggaaugcagcugcuauccccgcuacccuggcgugagaugugucugccgggacaacuggaagggguccaaucgccccaucguggauauuaacaucaaagacuacagcauuguuucuuccuauguguguagcggaaucgucggcgacacaccgagaaagaaugauucuagcuccucuagccauugccuugacccuaacaaugaggaaggcgggcacggagugaaaggcugggccuuugaugacgggaacgauguuuggaugggacggaccaucuccgagaagcugcgcagcggcuacgagacguucaaagugauugaaggguggucuaaucccaacuccaagcuccagaucaauagacaggucauuguggaccggggaaaccgcagcggcuauucuggcaucuuuuccgucgaggggaaaagcuguauuaauagaugcuucuacguggaacugauccggggaagaaaggaggaaacagagguucuguggaccuccaacucuauuguggucuucuguggcaccagcgggacauauggaaccggcuccuggccugauggggcugacaucaaucucaugcccaucuga

SEQ ID NO: 205333 - RNA, 1410 nt, Artificial Sequence; identical to SEQ ID NO: 197736
  derived and/or modified sequence opt5 from neuraminidase__InfluenzaA__AFJ77993

SEQ ID NO: 205334 - RNA, 1410 nt, Artificial Sequence
  derived and/or modified sequence opt5 from neuraminidase__InfluenzaA__AFJ78004
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuaagcucgcugaguacagaaauugguccaaaccccaguguaacauuaccggguucgccccuuuuucuaaggacaauagcauccggcuguccgcgggaggcgauaucugggugacacgcgagcccuaugucucuugcgacccugauaaguguuaccaauucgcucuugggcagggaaccacacugaacaaugugcauagcaacgacaccguucacgauagaacgccguaucggacacuccugaugaaugaacugggcgugcccuuucaucucgggaccaaacaggucugcauugccugguccucuagcuccugucacgacggaaaggccuggcugcaugugugcguuacaggcgaugacaaaaacgcuaccgccagcuucaucuacaauggccgccuuguggauucuauugucuccuggagcaaggagauccugagaacccaggaaucugagugugugugcauuaacgggacauguacgguggucaugaccgacggauccgcuagcggcaaagccgauacaaagauccucuuuaucgaggaagggaagauuguucacaccuccacacugucuggaagcgcgcaacacguggaggaaugcuccugcuauccucgguaccccggcgugcgcugugucugcagagacaacuggaaagggagcaaucggccuaucguggauauuaacaucaaggacuacucuauuguuuccagcuauguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucagcgagaaacuccggucuggcuacgagacauuuaaggugaucgaagggugguccaauccuaacagcaaacugcagauuaaucgccaggucaucguggacagaggaaaccggucuggcuauuccggcauuuucagcgucgaggggaaguccuguaucaaucgcugcuuuuacguggaacugauuagaggacggaaggaggaaaccgagguucucuggaccucuaacagcaucguggucuucuguggcacauccgggaccuauggaacaggcucuuggcccgauggggcugacauuaaucugaugccuaucuga

SEQ ID NO: 205335 - RNA, 1410 nt, Artificial Sequence; identical to SEQ ID NO: 197736
  derived and/or modified sequence opt5 from neuraminidase__InfluenzaA__AFJ78015

SEQ ID NO: 205336 - RNA, 1410 nt, Artificial Sequence; identical to SEQ ID NO: 204593
  derived and/or modified sequence opt5 from neuraminidase__InfluenzaA__AFJ78026

SEQ ID NO: 205337 - RNA, 1410 nt, Artificial Sequence; identical to SEQ ID NO: 204593
  derived and/or modified sequence opt5 from neuraminidase__InfluenzaA__AFJ78037

SEQ ID NO: 205338 - RNA, 1410 nt, Artificial Sequence
  derived and/or modified sequence opt5 from neuraminidase__InfluenzaA__AFJ78048
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggaaacgcuuccggcaaggccgauacaaaaauccucuuuaucgaggaagggaagauuguucacaccagcacacuguccggaucugcgcaacacguggaggaaugcagcugcuauccucgcuaccccggcgugagaugugucugccgggacaauuggaagggguccaaccgcccuaucguggauauuaauaucaaagacuacagcauuguuucuuccuauguguguagcggacuugucggcgacacccccagaaagaacgauucuagcuccucuagccauugccuggacccgaauaacgaggaaggcgggcacggagugaaaggcugggccuucgaugacgggaaugauguuuggaugggacggacgaucuccgagaagcuccgcagcggcuacgagacauuuaaagugaucgaaggguggucuaacccuaauuccaagcugcagauuaacagacaggucaucguggaccggggaaaucgcagcggcuauucuggcauuuucuccgucgaggggaaaagcuguaucaacagaugcuuuuacguggaacugauucggggaagaaaggaggaaaccgagguucucuggaccuccaauucuaucguggucuucuguggcacaagcgggaccuauggaacaggcuccuggcccgauggggcugacauuaaccugaugccuaucuga

SEQ ID NO: 205339 - RNA, 1410 nt, Artificial Sequence
  derived and/or modified sequence opt5 from neuraminidase__InfluenzaA__AFJ78059
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucaguguaacauuaccggguucgcccccuuuuccaaagacaauucuauccgccugagcgcgggaggcgauaucugggugacaagagagccuuaugucuccugcgacccggauaaguguuaccaauucgcucuugggcagggaaccacacugaacaaugugcauucuaacgacaccguucacgaucggacgcccuaucgcacacuccugaugaaugaacugggcgugccuuuucaucucgggaccaagcaggucugcauugccuggagcuccagcucuugucacgacggaaaagccuggcugcaugugugcguuacaggcgaugacaagaacgcuaccgccuccuucaucuacaauggcagacuuguggauagcauugucucuugguccaaagagauccugcggacccaggaaagcgagugugugugcauuaacgggacauguacgguggucaugaccgacggaucugcuuccggcaaggccgauacaaaaauccucuuuaucgaggaagggaagauuguucacaccagcacacuguccggaucugcgcaacacguggaggaaugcagcugcuauccccgcuacccuggcgugagaugugucugccgggacaacuggaagggguccaaucgccccaucguggauauuaacaucaaagacuacagcauuguuucuuccuauguguguagcggacuugucggcgacaccccgagaaagaaugauucuagcuccucuagccauugccuggacccuaacaaugaggaaggcgggcacggagugaaaggcugggccuucgaugacgggaacgauguuuggaugggacggacgaucuccgagaagcuccgcagcggcuacgagacauuuaaagugaucgaaggguggucuaaucccaacuccaagcugcagauuaauagacaggucaucguggaccggggaaaccgcagcggcuauucuggcauuuucuccgucgaggggaaaagcuguaucaauagaugcuuuuacguggaacugauucggggaagaaaggaugagaccgaaguucucuggaccuccaacucuaucguggucuucuguggcacaagcgggaccuauggaacaggcuccuggccugacggggcugauauuaaucugaugcccaucuga

SEQ ID NO: 205340 - RNA, 1410 nt, Artificial Sequence
  derived and/or modified sequence opt5 from neuraminidase__InfluenzaA__AFJ78070
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccuagauaccccggcgugcggugugucugccgcgacaacuggaaagggagcaacagaccuaucguggauauuaauaucaaggacuacucuauuguuuccagcuauguguguucuggacuugucggcgacacgccccggaaaaacgauagcuccucuagcggccacugccuggacccgaauaacgaggaagggggacauggcgugaaggggugggccuucgaugacggaaaugauguuuggaugggccgcaccaucuccgagaaaagcagaucuggguacgagacauuuaaggugaucgaaggaugguccaacccuaauagcaaacuccagauuaaccggcaggucaucguggaccgcggcaauagaucuggcuauuccgggauuuucagcgucgagggaaaguccuguaucaaccggugcuuuuacguggaacugauuagaggccgcaaggaggaaaccgagguucuguggaccucuaauagcaucguggucuucugugggacauccggaaccuauggcacagggucuuggcccgauggcgcugacauuaaccucaugccuaucuga

SEQ ID NO: 205341 - RNA, 1410 nt, Artificial Sequence
  derived and/or modified sequence opt5 from neuraminidase__InfluenzaA__AFJ78081
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacaauagcuccucuagccauugccuggauccgaacaaugaggaaggcgggcacggagucaaaggcugggccuucgacgaugggaacgacguguggaugggacgcaccaucuccgagaagucuagacucggcuaugagacauuuaaaguuauugaaggguggucuaauccuaacuccaagcugcagaugaaucgccaggugaucgucgaucggggaaacagaagcggcuacucuggcauuuucuccguggaggggaaaagcuguaucaaucggugcuuuuaugucgaacugauuagaggacgcaaggaggaaaccgaggugcucuggaccuccaacucuaucguuguguucuguggcacaagcgggaccuacggaacaggcuccuggcccgacggggcugauauuaaucugaugccuaucuga

SEQ ID NO: 205342 - RNA, 1410 nt, Artificial Sequence; identical to SEQ ID NO: 205258
  derived and/or modified sequence opt5 from neuraminidase__InfluenzaA__AFJ78092

SEQ ID NO: 205343 - RNA, 1410 nt, Artificial Sequence
  derived and/or modified sequence opt5 from neuraminidase__InfluenzaA__AFJ78103
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugcuuggaucugcgcaacacguugaggaaugcagcugcuauccuagauaccccggcgugcggugugugugccgcgauaacuggaagggguccaacagaccuauugucgacaucaauauuaaagaccacagcaucgugucuuccuacguuuguagcggacuggugggcgauacgccccggaagaacgacucuagcuccucuggccauugccucgauccgaauaacgaggaagggggacacggcgucaaagggugggccuucgacgauggaaaugacguguggaugggccgcaccaucagcgagaaguccagacugggguaugagacauuuaaaguuauugaaggauggagcaacccuucuuccaagcugcagaucaaucgccaggugauugucgaucggggcaacagaagcggcuacucugggaucuucuccguggagggaaaaagcuguauuaaucggugcuuuuaugucgaacucaucagaggccgcaaggaggaaaccgaggugcuguggaccuccaacucuauuguuguguucugugggacaagcggaaccuacggcacaggguccuggcccgacggcgcugauaucaaucuuaugccuaucuga

SEQ ID NO: 205344 - RNA, 1410 nt, Artificial Sequence
  derived and/or modified sequence opt5 from neuraminidase__InfluenzaA__AFJ78114
augaaccccaaucagaagaucauuaccaucggcagcgugucccugacaauuucuacgaucugcuucuuuaugcaaauugccauccucaucaccacagucacccugcacuucaaacaguacgagcuuaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccagugugacauuaccggguuugccccuuucucuaaagauaacagcauccgccuuuccgcgggaggcgacaucugggugacaagagagcccuaugucucuugcgauccugacaaguguuaccaauuugcucuggggcagggaaccacacucaauaacgugcauagcaaugauaccguucgggaccgcacgccguauagaacacugcugaugaacgaacucggcgugcccuuccaccuggggaccaagcaggucugcauugccugguccucuagcuccugucaugauggaaaagccuggcuucacgugugcaucacaggcgacgauaagaaugcuaccgccagcuuuauuuacaacggccggcugguugacucuaucguguccuggagcaaagagauucuccgcacccaggaaucugagugugucugcaucaaugggacauguacgguggugaugaccgauggauccgcuagcggcaaggccgacacaaaaauccuguucauugaggaagggaagaucguccauaccuccacacuuucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuggugggcgauacgccccggaagaacgacagcuccucuagcucccauugccucgauccgaauaacgaggaaggcgggcacggagucaaaggcugggccuuugacgaugggaaugacguguggaugggacgcaccaucagcgagaagucuagacugggcuaugagacauucaaaguuauugaagggugguccaacccuaauagcaagcugcagaucaaccgccaggugauugucgaucggucuaauagauccggauacagcggcaucuuuuccguggagggcaaaucuuguauuaaccggugcuucuaugucgaacucaucagagggcgcaaggaggaaaccgaggugcuguggaccagcaauuccauuguuguguuuuguggaacaucuggcaccuacgggacaggaagcuggcccgacggcgcugauaucaaccuuaugccuaucuga

SEQ ID NO: 205345 - RNA, 1410 nt, Artificial Sequence
  derived and/or modified sequence opt5 from neuraminidase__InfluenzaA__AFJ78125
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaugugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcaucgccugguccucuagcuccugucaugauggaaaagccuggcugcacgugugcauuacaggcgacgauaagaaugcuaccgccagcuucaucuacaacggccggcuuguugacucuauuguguccuggagcaaagagauccugcgcacccaggaaucugagugugucugcauuaaugggacauguacgguggugaugaccgauggauccgcuagcggcaaggccgacacaaaaauccucuuuaucgaggaagggaagauuguccauaccuccacacugucuggaagcgcgcaacacguugaggaaugcuccugcuauccuagauaccccggcgugcggugugugugccgcgauaacuggaaggggagcaacagaccuaucgucgacauuaauaucaaagaccacucuauuguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuaucgaagggugguccaacccuaauagcaagcugcagaugaaccgccaggugauugucgaucggggaaauagaucuggcuacuccggcaucuucagcguggaggggaaauccuguauuaaccggugcuuuuaugucgaacugaucagaggacgcaaggaggaaaccgaggugcucuggaccucuaauagcauuguuguguucuguggcacauccgggaccuacggaacaggcucuuggcccgacggggcugauaucaaccugaugccuauuuga

SEQ ID NO: 205346 - RNA, 1410 nt, Artificial Sequence
  derived and/or modified sequence opt5 from neuraminidase__InfluenzaA__AFJ78136
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuauuguguccuggagcaaagagauccugcgcacacaggaaucugagugugucugcauuaacgggacguguaccguggugaugacagacggauccgcuagcggcaaggccgauaccaaaauccucuuuaucgaggaagggaagauuguccauacauccacccugucuggaagcgcgcaacacguugaggaaugcuccugcuauccuagauaccccggcgugcggugugugugccgcgacaacuggaaggggagcaauagaccuaucgucgauauuaacaucaaagaccacucuauuguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcacaaucagcgagaagucuagacucggcuaugagaccuuuaaaguuaucgaagggugguccaauccuaagagcaaacugcagauuaaccgccaggugaucgucgaccggggaaauagaucuggcuacuccggcauuuucagcguggaggggaaguccuguaucaaccggugcuuuuaugucgaacugauuagaggacgcaaggaggaaaccgaggugcucuggacaucuaauagcaucguuguguucuguggcaccuccgggacauacggaacgggcucuuggcccgauggggcugacauuaaccugaugccuaucuga

SEQ ID NO: 205347 - RNA, 1410 nt, Artificial Sequence; identical to SEQ ID NO: 205346
  derived and/or modified sequence opt5 from neuraminidase__InfluenzaA__AFJ78147

SEQ ID NO: 205348 - RNA, 1410 nt, Artificial Sequence; identical to SEQ ID NO: 205346
  derived and/or modified sequence opt5 from neuraminidase__InfluenzaA__AFJ78158

SEQ ID NO: 205349 - RNA, 1410 nt, Artificial Sequence; identical to SEQ ID NO: 198908
  derived and/or modified sequence opt5 from neuraminidase__InfluenzaA__AFJ78169

SEQ ID NO: 205350 - RNA, 1410 nt, Artificial Sequence; identical to SEQ ID NO: 199426
  derived and/or modified sequence opt5 from neuraminidase__InfluenzaA__AFJ78180

SEQ ID NO: 205351 - RNA, 1410 nt, Artificial Sequence; identical to SEQ ID NO: 198908
  derived and/or modified sequence opt5 from neuraminidase__InfluenzaA__AFJ78191

SEQ ID NO: 205352 - RNA, 1410 nt, Artificial Sequence
  derived and/or modified sequence opt5 from neuraminidase__InfluenzaA__AFJ78202
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaucaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaggcgcgcaacacguugaggaaugcagcugcuauccuagauaccccggggugcggugugugugccgcgacaacuggaagggauccaauagaccuauugucgauaucaacauuaaagaccacagcaucgugucuuccuacguuuguagcggccuugugggcgacacgccccggaagaaugauucuagcuccucuagccauugccuggacccgaacaaugaggaagggggacacggcgucaaagggugggccuucgaugacggaaacgauguguggaugggccgcaccaucuccgagaagucuagacucggguaugagacauuuaaaguuauugaaggauggucuaauccuaaguccaaacugcagaucaaccgccaggugauugucgaccggggcaauagaagcggcuacucugggaucuucuccguggagggaaagagcuguauuaaccggugcuuuuaugucgaacugaucagaggccgcaaggaggaaaccgaggugcucuggaccuccaauucuauuguuguguucugugggacaagcggaaccuacggcacaggguccuggcccgauggcgcugacaucucucugaugccuaucuga

SEQ ID NO: 205353 - RNA, 1410 nt, Artificial Sequence
  derived and/or modified sequence opt5 from neuraminidase__InfluenzaA__AFJ78213
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgaucggggaaacagaucuggcuacuccggcaucuucagcguggaggggaaguccuguauuaaucggugcuuuuaugucgaacugaucagaggacgcaaggaggaaaccgaggugcucuggaccucuaacagcauuguuguguucuguggcacauccgggaccuacggaacaggcucuuggcccgacggggcugauaucaaucugaugcuuaucuga

SEQ ID NO: 205354 - RNA, 1410 nt, Artificial Sequence; identical to SEQ ID NO: 198908
  derived and/or modified sequence opt5 from neuraminidase__InfluenzaA__AFJ78224

SEQ ID NO: 205355 - RNA, 1410 nt, Artificial Sequence; identical to SEQ ID NO: 198908
  derived and/or modified sequence opt5 from neuraminidase__InfluenzaA__AFJ78235

SEQ ID NO: 205356 - RNA, 1410 nt, Artificial Sequence
  derived and/or modified sequence opt5 from neuraminidase__InfluenzaA__AFJ78246
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccaggcuaugcuuugugaacccacaauuaucgagagaaauauuaccgaaaucguuuaucugacaaacaccacgauugagaaggaaaucugcccuaaacucgccgaguaccggaauugguccaagccccagugugacauuaccggguucgcgccuuuuucuaaagauaacagcauccgccuguccgcuggaggcgacaucugggugacaagagagcccuaugugucuugcgauccugacaaguguuaccaauucgcccuugggcagggaaccacacugaauaacguccauagcaaugauaccgugcgggaccgcacgccguauagaacacuccugaugaacgaacugggcguucccuuucaccucgggaccaaacaggugugcauugccugguccucuagcuccugucaugauggaaaggcuuggcugcacgucugcaucacaggcgacgauaagaaugccaccgcuagcuucauuuacaacggccggcuuguggacucuaucguuuccuggagcaaagagauucugcgcacccaggaaucugagugugugugcaucaaugggacauguacggucgugaugaccgauggauccgccagcggcaaggcggacacaaaaauccucuuuauugaggaagggaagaucgugcauaccuccacacugucuggaagcgcccaacacgucgaggaaugcuccugcuauccuagauaccccggcguucggugugugugccgcgauaacuggaaggggagcaacagaccuauuguggacaucaauauuaaagaccacucuaucgucuccagcuacguguguucuggacuuguuggcgauacgccccggaagaacgacagcuccucuagcucccauugccuggauccgaauaacgaggaaggcgggcacggagugaaaggcugggcuuucgacgaugggaaugacgucuggaugggacgcaccaucagcgagaagucuagacucggcuaugagacauuuaaagugauugaagggugguccaacccuaagagcaaacugcagaucaaucggcagguuauuguggaucgcggaaacagaucuggcuacuccggcaucuucagcgucgaggggaaguccuguauuaaucggugcuuuuauguggaacugaucagaggacgcaaggaggaaaccgagguccucuggaccucuaacagcauugugguuuucuguggcacauccgggaccuacggaacaggcucuuggcccgacggggccgauaucaaucugaugccuaucuga

SEQ ID NO: 205357 - RNA, 1410 nt, Artificial Sequence
  derived and/or modified sequence opt5 from neuraminidase__InfluenzaA__AFJ78268
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuauuguguccuggagcaaagagauccugcgcacacaggaaucugagugugucugcauuaacgggacguguaccguggugaugacagacggauccgcuagcggcaaggccgauaccaaaauccucuuuaucgaggaagggaagauuguccauacauccaagcugucuggaagcgcgcaacacguugaggaaugcuccugcuauccuagauaccccggcgugcggugugugugccgcgacaacuggaaagggagcaauagaccuaucgucgauauuaacaugaaggaccacucuaucguguccagcuacguuuguucuggacuugugggcgacacgccccggaaaaaugauagcuccucuagcucccauugccuggacccgaacaaugaggaaggcgggcacggagucaagggcugggccuucgaugacgggaacgauguguggaugggacgcaccauuagcgagaaaucuagacucggcuaugagacauuuaagguuaucgaagggugguccaauccuaaaagcaagcugcagaucaaccgccaggugauugucgaccggggaaauagaucuggcuacuccggcaucuucagcguggaggggaaguccuguauuaaccggugcuuuuaugucgaacugaucagaggacgcaaagaggaaaccgaggugcucuggaccucuaauagcauuguuguguucuguggcacauccgggaccuacggaacaggcucuuggcccgauggggcugacaucaaccugaugccuauuuga

SEQ ID NO: 205358 - RNA, 1410 nt, Artificial Sequence
  derived and/or modified sequence opt5 from neuraminidase__InfluenzaA__AFJ78279
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaucaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaggcgcgcaacacguugaggaaugcagcugcuauccuagauaccccggggugcggugugugugccgcgacaacuggaagggauccaauagaccuauugucgauaucaacauuaaagaccacagcaucgugucuuccuacguuuguagcggccuugugggcgacacgccccggaagaaugauucuagcuccucuagccauugccuggacccgaacaaugaggaagggggacacggcgucaaagggugggccuucgaugacggaaacgauguguggaugggccgcaccaucuccgagaagucuagacucggguaugagacauuuaaaguuauugaaggauggucuaauccuaaguccaaacugcagaucaaccgccaggugauugucgaccggggcaauagaagcggcuacucugggaucuucuccguggagggaaagagcuguauuaaccggugcuuuuaugucgaacugaucagaggccgcaaggaggaaaccgaggugcucuggaccuccaauucuauuguuguguucugugggacaagcggaaccuacggcacaggguccuggcccgauggcgcugacaucaaccugaugccuaucuga

SEQ ID NO: 205359 - RNA, 1410 nt, Artificial Sequence
  derived and/or modified sequence opt5 from neuraminidase__InfluenzaA__AFJ78290
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccgcgcugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucagcgagaagucuagacucggcuaugagacguuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaacagagguucucuggaccucuaauagcaucguggucuucuguggcaccuccgggacauacggaaccggcucuuggcccgauggggccgacauuaaccugaugccuaucuga

SEQ ID NO: 205360 - RNA, 1413 nt, Artificial Sequence
  derived and/or modified sequence opt5 from neuraminidase__InfluenzaA__AFJ78312
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuugggagaaacggauucucagaacgcaggaguccgaaugcguuugugugaauggcagcugcuuuacaaucaugaccgauggccccucuaacggggcugccagcuacaagaucuucaaaauugagaagggaaaggucacaaaauccaucgaacugaaugcuccuaacucucacuaugaggaguguagcugcuacccggacaccggcaccgugaugugugugugccgcgauaauuggcacggguccaacagacccugggucagcuuuaaucagaaccuugacuaccagauuggauauaucugcucuggcguuuucggggauaauccucggcccaaggacggagaaggcuccuguaacccugugacagccgauggcgcggacggggugaaaggauuuagcuacaaguauggcaauggggucuggauuggacgcacgaaaucuaacagacugcggaagggcuucgagaugaucugggaccccaauggguggaccgauacagacuccgauuuuagcgugaaacaagacguuguggccauuaccgauugguccggcuacucuggauccuucguccagcauccggaacucacaggccuggacugcauccgcccuuguuuuuggguggagcuuguuagagggcggccccgcgaaaacaccacgaucuggacauccggaucuagcauuuccuucugcggcgugaauagcgauaccgcuaacuggucuuggccugacggggccgagcugcccuucaccaucgauaaguga

SEQ ID NO: 205361 - RNA, 1410 nt, Artificial Sequence; identical to SEQ ID NO: 205293
  derived and/or modified sequence opt5 from neuraminidase__InfluenzaA__AFJ78323

SEQ ID NO: 205362 - RNA, 1413 nt, Artificial Sequence
  derived and/or modified sequence opt5 from neuraminidase__InfluenzaA__AFJ78334
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgggauaauuggcacgggagcaaccgccccugggucuccuucaaucagaaccuugacuaccaaauuggauauaucugcagcggcguuuuuggggauaauccuagacccaaagacggagagggcucuuguaacccugugacaguggauggcgccgacggggucaagggauucuccuacaaauauggcaaugggguguggauuggacggacgaaguccaaccgccugagaaaaggcuuugaaaugaucugggaccccaauggguggaccgauacagacucugauuucuccguuaagcaggacguggucgcgauuaccgauuggagcggcuacuccggaucuuuugugcagcauccggagcucacaggccuggacugcauccggccuuguuucuggguugaacuugugcgcgggcugcccagagagaacaccacgaucuggacaagcggauccucuauuagcuucugcggcgucaauuccgauaccgccaacuggagcuggccugacggggcugaacuccccuuuaccaucgauaaguga

SEQ ID NO: 205363 - RNA, 1413 nt, Artificial Sequence; identical to SEQ ID NO: 205362
  derived and/or modified sequence opt5 from neuraminidase__InfluenzaA__AFJ78345

SEQ ID NO: 205364 - RNA, 1413 nt, Artificial Sequence
  derived and/or modified sequence opt5 from neuraminidase__InfluenzaA__AFJ78356
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggugggaaaagacaagaccucugucacacuggccggcaauagcucccuuuguagcauuucugggugggcgaucuacaccaaagauaacuccauucggaucggaagcaagggcgacguguucguuauucgcgaaccuuuuaucucuugcucccaucuggaguguagaacguucuuucucacccaaggcgcucugcuuaaugauaaacacagcaacgggacagugaaggaccggucuccguaucgcgcccugauguccugcccccucggagaagccccuagccccuacaauuccaaguucgagucugucgcuuggagcgccuccgcuugucaugauggcaugggguggcugaccaucggaauuagcggcccugacaacggggccguggcgguucugaaauauaacggaaucauuacagaaaccaucaagucuuggaaaaagcagauucucagaacgcaggaguccgagugcgugugugucaauggcagcugcuuuacaaucaugaccgauggccccucuaacggggccgcuagcuacaaaaucuucaagauugaaaagggaaaagugacaaaguccaucgagcugaaugccccuaacuuucacuaugaagaguguucuugcuacccggacaccggcaccgugauguguauuugccgggauaauuggcacgggagcaaccgccccugggucuccuucaaucagaaccuugacuaccaaaucggauauauuugcagcggcguuuuuggggauaauccuagacccaaagacggagagggcucuuguaacccugugacaguggauggcgcugacggggucaagggauucuccuacaaauauggcaaugggguguggaucggacggacgaaguccaaccgccugagaaaaggcuuugaaaugauuugggaccccaauggguggaccgauacagacucugauuucuccguuaagcaggacguggucgccaucaccgauuggagcggcuacuccggaucuuuugugcagcauccggagcucacaggccuggacugcauccggccuuguuucuggguugaacuugugcgcgggcugcccagagagaacaccacgauuuggacaagcggauccucuaucagcuucugcggcgucaauuccgauaccgcgaacuggagcuggccugacggggccgaacuccccuuuaccauugauaaguga

SEQ ID NO: 205365 - RNA, 1413 nt, Artificial Sequence
  derived and/or modified sequence opt5 from neuraminidase__InfluenzaA__AFJ78367
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacucucacuaugaagaguguagcugcuacccggacaccggcaccgugaugugugugugccgcgauaauuggcacggguccaacagacccugggucagcuuuaaucagaaccuugacuaccagauuggauauaucugcucuggcguuuucggggauaauccucggcccaaagacggagagggcuccuguaacccugugacagccgauggcgcggacggggugaagggauuuagcuacaaauauggcaauggggucuggauuggacgcacgaagucuaacagacugcggaaaggcuucgaaaugaucugggaccccaauggguggaccgauacagacuccgauuuuagcgugaagcaagacguuguggccauuaccgauugguccggcuacucuggauccuucguccagcauccggagcucacaggccuggacugcauccgcccuuguuuuuggguggaacuuguuagagggcggccccgcgagaacaccacgaucuggacauccggaucuagcauuuccuucugcggcgugaauggggauaccgcuaacuggagcuggccugacggagccgaacugcccuucaccaucgauaaguga

SEQ ID NO: 205366 - RNA, 1413 nt, Artificial Sequence
  derived and/or modified sequence opt5 from neuraminidase__InfluenzaA__AFJ78378
augaaccccaaucagaaggugaucaccauuggcagcaucuccauugccaucgggauuaucucucugaugcuccaaaucggaaacauuaucagcauuugggcuucccacucuauccagacaggcagccagaaucauacggggauuugcaaccagagaaucauuaccuacgaaaauuccacaugggugaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgagccuuuuauuucuugcucccauauggaguguagaacguucuuucugacccaaggcgcccuccugaaugauaaacacagcaacgggacagugaaggaccggucuccguaucgcgcccuuauguccugcccccugggagaagcuccuagccccuacaauuccaaguucgagucugucgccuggagcgcuuccgccugucaugauggcaugggguggcucaccaucggaaucagcggcccugacaacggggcgguggccguucugaaauauaacggaauuaucacagaaaccauuaagucuuggaaaaagagaauccugcggacgcaggaguccgagugcgugugugucaauggcagcugcuuuacaauuaugaccgauggccccucuaacggggcugccagcuacaaaaucuucaagaucgaaaagggaaaagugacaaaguccauugagcucaaugcuccuaacucucacuaugaagaguguagcugcuacccggacaccggcaccgugaugugugucugccgcgauaauuggcacggguccaacagacccuggguuagcuuuaaucagaaccuggacuaccagaucggauauauuugcucuggcguguucggggauaauccucggccccgcgacggagagggcuccuguaacccugugacagucgauggcgccgacggggugaaaggauuuagcuacaaguauggcaaugggguuuggaucggaagaacgaaaucuaaccggcuucgcaagggcuucgaaaugauuugggaccccaauggguggaccgauacagacuccgauuuugcggugaaacaagacgucguggccaucaccgauuggagcggcuacuccggaucuuucguucagcauccggagcugacaggccucgacugcauuagaccuuguuuuuggguggaacugguccgggggcuuccccgcgagaacaccacgaucuggacaagcggauccucuaucagcuucugcggcgucaauuccgauaccgcuaacuggagcuggccugacggggccgaacugcccuucaccauugauaaguga

SEQ ID NO: 205367 - RNA, 1413 nt, Artificial Sequence; identical to SEQ ID NO: 197410
  derived and/or modified sequence opt5 from neuraminidase__InfluenzaA__AFJ78389

SEQ ID NO: 205368 - RNA, 1413 nt, Artificial Sequence; identical to SEQ ID NO: 197410
  derived and/or modified sequence opt5 from neuraminidase__InfluenzaA__AFJ78400

SEQ ID NO: 205369 - RNA, 1413 nt, Artificial Sequence; identical to SEQ ID NO: 197410
  derived and/or modified sequence opt5 from neuraminidase__InfluenzaA__AFJ78411

SEQ ID NO: 205370 - RNA, 1413 nt, Artificial Sequence
  derived and/or modified sequence opt5 from neuraminidase__InfluenzaA__AFJ78422
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaccggguggcugacaaucggaauuagcggcccugacaacggggcggucgccgugcugaaauauaacggaaucauuaccgaaacgaucaagucuuggaaaaagcggauucucagaacacaggaguccgagugcguuuguaugaauggcagcugcuuuaccaucaugacagauggccccucuaacggggcugccagcuacaaaaucuucaagauugaaaagggaaaagugaccaaguccaucgagcugaaugcuccuucuuuucacuaugaagaguguagcugcuacccggacaccggcacagucaugugugugugccgcgauaacuggcacggguccaauagacccugggugagcuucaaccagaaucuugacuaccagauuggauauaucugcucuggcgucuuuggggauaacccucggccccaagacggagagggcuccuguaauccuguuacgguggauggcgccgacggggugaaaggauucagcuacaaguauggcaacggggucuggauuggacgcaccaaaucuaauagacugcggaagggcuuugaaaugaucugggaccccaacggguggacaaauaccgauuccgacuucagcgugaaacaggauguuguggcgauuacagacugguccggcuacucuggauccuuuguccagcauccggagcucaccggccuggauugcauccgcccuuguuucuggguggaacuuguuagagggcugccccgggagaacacgacaaucuggaccuccggaucuagcauuuccuucugcggcgugaauagcgacaccgccaacuggucuuggccugauggggcugaacuccccuuuacaaucgacaaguga

SEQ ID NO: 205371 - RNA, 1413 nt, Artificial Sequence; identical to SEQ ID NO: 199517
  derived and/or modified sequence opt5 from neuraminidase__InfluenzaA__AFJ78433

SEQ ID NO: 205372 - RNA, 1413 nt, Artificial Sequence; identical to SEQ ID NO: 199517
  derived and/or modified sequence opt5 from neuraminidase__InfluenzaA__AFJ78444

SEQ ID NO: 205373 - RNA, 1413 nt, Artificial Sequence
  derived and/or modified sequence opt5 from neuraminidase__InfluenzaA__AFJ78466
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaucggguggcugaccauuggaaucagcggcccugacaacggggcggucgccgugcugaaauauaacggaauuaucacaggcaccauuaagucuuggaaaaagcagauccucagaacgcaggaauccgagugcguuuguaucaauggcagcugcuuuacaauuaugaccgaugggcccucuaacggagcugccagcuacaaaaucuucaagauugagaagggcaaagugacaaaguccaucgaacugaaugcuccuaacuuucacuaugaggaauguucuugcuacccggacaccgggaccgucaugugugugugccgggauaauuggcacggaagcaaccgccccuggguguccuucaaucagaaccuugacuaccaaauuggcuauaucugcagcggggucuuuggagauaauccuagacccaaagacggcgagggccgguguaacccuguuacaguggauggggccgacggagugaagggcuucucuuacaaauaugggaauggagucuggauuggccgcacgaaguccaacagacugcggaaaggguuugagaugaucugggaccccaauggcuggaccaacacagauagcgacuucucugugaagcaggauguuguggcgaucaccgacugguccggauacagcggcuccuuuguccagcauccggaacucacagggcuggauugcauucgcccuuguuucuggguggagcuuguuagaggacugccccgggaaaauaccacgaucuggacaucuggcagcuccauuucuuucugcggggugaacagcgacaccgccaacugguccuggccugauggagcugagcuccccuuuaccaucgacaaguga

SEQ ID NO: 205374 - RNA, 1413 nt, Artificial Sequence
  derived and/or modified sequence opt5 from neuraminidase__InfluenzaA__AFJ78477
augaaccccaaucagaagaucauuaccaucggcagcauuuccaucgccauugggaucaucggacugaugcuccaaauuggcaacaucauuucuaucugggcuagccacuccauucagacagggucucagaaucauacgggaaucugcagccagagaauuaucaccuacgagaacuccacaugggugaauaacaccuaugucaauaucaacaauacaaacguuguggccgaaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaccuggaauguagaacguucuuucucacccaaggcgcccugcuuaaugauaaacauagcaacgggacaguuaaggaccggucuccguaucgcgcccugauguccugcccccucggagaggcuccuagccccuacaauuccagauucgaaucuguggccuggagcgcuuccgccugucacgauggcaugggguggcugaccaucggaauuagcggcccugacaacggggcggucgccgugcugaaguauaacggaaucauuacagagaccaucaaaucuuggaagaaacggauucuccgcacgcaggaguccgaaugcguuuguaugaauggcagcugcuuuacaaucaugaccgauggccccucuaacggggcugccagcuacaagaucuucaaaauugagaagggaaaggugacaaaauccaucgaacugaaugcuccuaacuuucauuaugaggaguguucuugcuacccggacaccggcaccgucaugugugugugcagagauaauuggcacgggagcaaccggcccuggguguccuucaaucagaaccuugacuaccagauuggauauaucugcagcggcgucuuuggggauaauccucgccccaaggacggagaaggcucuuguaacccuguuacaguggauggcgccgacggggugaaaggauucuccuacaaguauggcaauggggucuggauuggaagaacgaaaagcaaccggcugcgcaagggcuuugagaugaucugggaccccaauggguggaccaacacagauucugacuucuccgugaaacaagauguuguggcgauuaccgacuggagcggcuacuccggaucuuuuguccagcacccggaacucacaggccuggauugcaucagaccuuguuucuggguggagcuuguucgggggcugccccgcgaaaauaccacgaucuggacaagcggauccucuauuagcuucugcggcgugaacuccgggaccgccaacuggagcuggccugacggagcugagcuccccuuuaccaucgauaaguga

SEQ ID NO: 205375 - RNA, 1413 nt, Artificial Sequence
  derived and/or modified sequence opt5 from neuraminidase__InfluenzaA__AFJ78488
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguuguggccgagaaagacaagaccucugugacacuggcgggaaacagcucccuuuguagcaucucuggcugggcuauuuacaccaaagauaauuccauccggauugggagcaagggagacgucuucgugauccgcgagccuuuuaucucuugcucccaccuggaauguagaacguucuuucucacccaaggcgcccugcuuaacgauaaacauagcaauggcacaguuaaggaccggucuccguaucgcgcccugauguccugcccccucggggaggcuccuagccccuacaacuccagauucgaaucuguggccuggagcgcuuccgccugucacgauggaaugggcuggcugaccauugggaucagcggaccugacaacggcgcggucgccgugcugaaguauaaugggauuaucacagagaccauuaaaucuuggaagaaacggauccuccgcacgcaggaguccgaaugcguuuguaugaacggaagcugcuuuacaaucaugaccgauggccccucuaauggcgcugccagcuacaagauuuucaaaaucgagaaggggaaggugacaaaaaccauugaacugaacgcuccuaauuuucauuaugaggaguguuccugcuacccggacaccggaacagucaugugugugugcagagauaacuggcacggcucuaaucggcccugggugagcuucaaccagaaucuugacuaccagaucggguauauuugcuccggagucuuuggcgauaacccucgccccaaggacggggaaggaagcuguaauccuguuacgguggauggcgccgacggcgugaaaggguucucuuacaaguauggaaacggcgucuggaucgggagaaccaaauccaaucggcugcgcaagggauuugagaugauuugggaccccaacggcuggacaaauaccgauagcgacuucucuaugaaacaagaugugguugcgaucacagacugguccggguacagcggcuccuuugugcagcacccggaacucaccggacuggauugcaucagaccuuguuucugggucgagcuugugcggggccugccccgcgaaaacacgacaauuuggaccucugggagcuccaucucuuucugcggaguuaacagcggcaccgccaauugguccuggccugacggggcugagcuccccuuuacaauugauaaguga

SEQ ID NO: 205376 - RNA, 1413 nt, Artificial Sequence
  derived and/or modified sequence opt5 from neuraminidase__InfluenzaA__AFJ78510
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacaggcaccaucaagucuuggaaaaagcagauucucagaacgcaggaauccgagugcguuuguaugaauggcagcugcuuuacaaucaugaccgaugggcccucuaacggagcugccagcuacaaaaucuucaagauugagaagggcaaagugacaaaguccaucgaacugaaugcuccuaacuuucacuaugaggaauguucuugcuacccggacaccgggauugucaugugugugugccgggauaauuggcacggaagcaaccgccccuggguguccuucaaucagaaccuugacuaccaaaucggcuauauuugcagcggggucuuuggagauaauccuagacccaaagacggcgagggcucuuguaacccuguuaccguggauggggccgacggagugaagggcuucuccuacaaauaugacaauggggucuggaucggacggacaaagagcaaccgccugagaaaaggcuuugagaugauuugggaucccaauggguggacgaacaccgacucugauuucuccgugaagcaggacguuguggcgaucacagauuggagcggcuacuccggaucuuuuguccagcauccggaacucaccggccuggacugcauccggccuuguuucuggguggagcuuguucgcgggcugcccagagaaaauacaaccauuuggacgagcggauccucuaucagcuucugcggcgugaacuccgauacagccaacuggagcuggccugacggggcugagcuccccuuuaccauugauaaguga

SEQ ID NO: 205377 - RNA, 1413 nt, Artificial Sequence
  derived and/or modified sequence opt5 from neuraminidase__InfluenzaA__AFJ78521
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguuguggccgagaaagacaagaccucugugacacuggcgggaaacagcucccuuuguagcaucucuggcugggcuauuuacaccaaagauaauuccauccggauugggagcaagggagacgucuucgugauccgcgagccuuuuaucucuugcucccaccuggaauguagaacguucuuucucacccaaggcgcccugcuuaacgauaaacauagcaauggcacaguuaaggaccggucuccguaucgcgcccugauguccugcccccucggggaggcuccuagccccuacaacuccagauucgaaucuguggccuggagcgcuuccgccugucacgauggaaugggcuggcugaccauugggaucagcggaccugacaacggcgcggucgccgugcugaaguauaaugggauuaucacagagaccauuaaaucuuggaagaaacggauccuccgcacgcaggaguccgaaugcguuuguaugaacggaagcugcuuuacaaucaugaccgauggccccucuaauggcgcugccagcuacaagauuuucaaaaucgagaaggggaaggugacaaaaaccauugaacugaacgcuccuaauuuucauuaugaggaguguuccugcuacccggacaccggaacagucaugugugugugcagagauaacuggcacggcucuaaucggcccugggugagcuucaaccagaaucuugacuaccagaucggguauauuugcuccggagucuuuggcgauaacccucgccccaaggacggggaaggaagcuguaauccuguuacgguggauggcgccgacggcgugaaaggguucucuuacaaguauggaaacggcgucuggaucgggagaaccaaauccaaucggcugcgcaagggauuugagaugauuugggaccccaacggcuggacaaauaccgauagcgacuucucugugaaacaagauguuguggcgaucacagacugguccggguacagcggcuccuuuguccagcacccggaacucaccggacuggauugcaucagaccuuguuucuggguggagcuuguucggggccugccccgcgaaaacacgacaauuuggaccucugggagcuccaucucuuucugcggagugaacagcggcaccgccaauugguccuggccugacggggcugagcuccccuuuacaauugauaaguga

SEQ ID NO: 205378 - RNA, 1413 nt, Artificial Sequence; identical to SEQ ID NO: 205271
  derived and/or modified sequence opt5 from neuraminidase__InfluenzaA__AFJ78532

SEQ ID NO: 205379 - RNA, 1413 nt, Artificial Sequence; identical to SEQ ID NO: 205271
  derived and/or modified sequence opt5 from neuraminidase__InfluenzaA__AFJ78543

SEQ ID NO: 205380 - RNA, 1413 nt, Artificial Sequence; identical to SEQ ID NO: 205271
  derived and/or modified sequence opt5 from neuraminidase__InfluenzaA__AFJ78554

SEQ ID NO: 205381 - RNA, 1413 nt, Artificial Sequence; identical to SEQ ID NO: 205259
  derived and/or modified sequence opt5 from neuraminidase__InfluenzaA__AFJ78565

SEQ ID NO: 205382 - RNA, 1413 nt, Artificial Sequence
  derived and/or modified sequence opt5 from neuraminidase__InfluenzaA__AFJ78576
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggcgggcaauucuagccuuuguuccauuagcgggugggcuauccauaccaaagauaacucuauucggaucggauccaagggcgacgucuucgugauucgcgagccguuuaucagcugcucucaccuggaguguaaaacguucuuucucacccaaggcgcccugcuuaaugauaagcauuccaacgggacaguuaaggacagaagccccuaccgggcccugaugucuugcccucucggagaagcucccuccccuuauaauagcaaauucgaguccguggccuggucugcuagcgccugucacgauggcaucggguggcugaccauuggaaucuccggccccgacaacggggcggucgccgugcugaaguacaacggaauuaucacaggcaccauuaaaagcuggaagaaacagauccuccgcacgcaggaaucugagugcguuuguaugaauggcuccugcuuuacaaucaugaccgaugggccuagcaacggagcugccucuuauaagauuuucaagaucgagaaaggcaaggugacaaaaagcauggaacugaaugcuccgaacuuucacuacgaggaauguuccugcuaucccgacaccgggaccgucaugugugugugcagagauaauuggcauggaucuaaccggccuugggugagcuucaaucagaaccuugacuaccaaauuggcuacaucugcacaggggucuuuggagauaauccccgcccugaggacggcgagggcuccuguaaccccguuacgguggauggggccaauggagugaagggcuucagcuauaaauacgggaacggagucuggauuggcagaaccaagucuaaucggauccgcaaaggguuugaaaugauuugggacccgaacggcuggacaaauaccgacuccgauuucagcgugaagcaggacaucguugcgaucacagauuggucuggauauuccggcagcuuugugcagcacccugagcugaccgggcucgacugcauuagacccuguuucugggucgaacuggugcggggacuuccucgcgagaacacgacaaucuggaccuccggcucuagcauuuccuucugcgggguuaacucugauaucgccaauuggagcuggcccgacggagcugaacugcccuuuaccauugauaaguga

SEQ ID NO: 205383 - RNA, 1413 nt, Artificial Sequence
  derived and/or modified sequence opt5 from neuraminidase__InfluenzaA__AFJ78598
augaaccccaaucagaagaucauuaccaucggcagcauuuccaucgccauugggaucaucucucugaugcuccaaauuggaaacaucauuagcaucugggcuucccacucuauucagacaggcauccagaauaacacggggauuugcaaucagagaaucaucaccuacgagaacagcacaugggugaaucauaccuaugucaacauuaauaacacaaauguuguggccggagaagacaaaaccuccgugacacuggcgggcaacucuagccuuuguuccaucagcgggugggcuauuuacaccaaggauaauucuauccggauuggauccaaaggcgacgucuucgugauccgcgagccuuuuaucagcugcucucaccuggaauguagaacguucuuucucacccaaggcgcccugcuuaacgauaagcauuccaaugggacaguuaaagaccggagcccguaucgcgcccugaugucuugcccccucggagaggcuccuucccccuacaacagcaaguucgaauccguggccuggucugcuagcgccugucacgauggcaugggguggcugaccauuggaaucuccggcccugacaacggggcggucgccgugcugaaguauaauggaauuaucacaggcaccauuaaaagcuggaagaaacagauccucagaacgcaggagucugagugcguuuguaugaacggcuccugcuuuacaaucaugaccgaugggcccagcaauaaggcugccucuuacaaaauuuucaagaucgaaaagggaaaagugacaaagagcauugagcugaacgcuccuaauuuucauuaugaagaguguuccugcuacccggacaccggcaucgucaugugugugugccgggauaacuggcacgggucuaaucgccccugggugagcuucaaccagaaucuugacuaccaaauuggauauaucugcuccggcgucuuuggggauaacccuagacccgaggacggagaaggcagcuguaauccuguuaccguggauggcgccaacggggugaaaggauucucuuacaaguaugacaauggcgucuggauugggcggacaaaauccaaccgccugagaaagggauuugagaugaucugggaccccaauggcuggacgaacaccgauagcgacuucucugugaaacaggauguuguggcgaucacagacugguccggguacagcggcuccuuuguccagcacccggaacucaccggacuggauugcauucggccuuguuucuggguggagcuuguucgcggccugcccagagaaaacacaaccaucuggacgucugggagcuccauuucuuucugcggagugaauagcgacacagccaacugguccuggccugauggcgcugagcuccccuuuaccaucgacaaguga

SEQ ID NO: 205384 - RNA, 1413 nt, Artificial Sequence
  derived and/or modified sequence opt5 from neuraminidase__InfluenzaA__AFJ78609
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugauucuggcgggcaacagcucccuuuguagcaucucugggugggcuauuuacacaaaggauaauuccauccggauuggaagcaaaggcgacgucuucgugauccgcgagccuuuuaucucuugcucccaccuggaauguagaaccuucuuucucacgcaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcaugggguggcugacaauuggaaucagcggcccugacaacggggcggucgccgugcugaaguauaauggaauuaucaccggcacaauuaaaucuuggaagaaacagauccucagaacccaggaguccgagugcguuuguaugaacggcagcugcuuuacgaucaugacagaugggcccucuaauaaggcugccagcuacaaaauuuucaagaucgaaaagggaaaagugaccaaguccauugagcugaacgcuccuaauuuuuauuacgaagaguguucuugcuacccggacacaggcaucgucaugugugugugccgggauaacuggcaugggagcaaucgccccuggguguccuucaaccagaaucuugacuaucaaauuggauacaucugcagcggcgucuuuggggauaacccuagacccgaggacggagaaggcucuuguaauccuguuaccguggauggcgccaacggggugaaaggauucuccuauaaguacggcaauggggucuggauuggacggaccaaaagcaaccgccugagaaagggcuuugagaugaucugggaccccaauggguggacaaacacggacucugauuucuccgugaaacaggacguuguggcgaucaccgauuggagcggcuauuccggaucuuuuguccagcacccggaacucacaggccuggacugcauucggccuuguuucuggguggagcuuguucgcgggcugcccagagaaaacaccacaaucuggaccagcggauccucuauuagcuucugcggcgucaauuccgauacggccaacuggagcuggccugacggggcugagcuccccuuuacaaucgauaaguga

SEQ ID NO: 205385 - RNA, 1413 nt, Artificial Sequence; identical to SEQ ID NO: 200485
  derived and/or modified sequence opt5 from neuraminidase__InfluenzaA__AFJ78620

SEQ ID NO: 205386 - RNA, 1413 nt, Artificial Sequence; identical to SEQ ID NO: 205259
  derived and/or modified sequence opt5 from neuraminidase__InfluenzaA__AFJ78631

SEQ ID NO: 205387 - RNA, 1413 nt, Artificial Sequence; identical to SEQ ID NO: 200485
  derived and/or modified sequence opt5 from neuraminidase__InfluenzaA__AFJ78642

SEQ ID NO: 205388 - RNA, 1413 nt, Artificial Sequence; identical to SEQ ID NO: 200485
  derived and/or modified sequence opt5 from neuraminidase__InfluenzaA__AFJ78653

SEQ ID NO: 205389 - RNA, 1410 nt, Artificial Sequence; identical to SEQ ID NO: 199762
  derived and/or modified sequence opt5 from neuraminidase__InfluenzaA__AFJ78664

SEQ ID NO: 205390 - RNA, 1410 nt, Artificial Sequence; identical to SEQ ID NO: 199762
  derived and/or modified sequence opt5 from neuraminidase__InfluenzaA__AFJ78674

SEQ ID NO: 205391 - RNA, 1410 nt, Artificial Sequence; identical to SEQ ID NO: 199762
  derived and/or modified sequence opt5 from neuraminidase__InfluenzaA__AFJ78684

SEQ ID NO: 205392 - RNA, 1410 nt, Artificial Sequence; identical to SEQ ID NO: 199762
  derived and/or modified sequence opt5 from neuraminidase__InfluenzaA__AFJ78694

SEQ ID NO: 205393 - RNA, 1410 nt, Artificial Sequence; identical to SEQ ID NO: 199762
  derived and/or modified sequence opt5 from neuraminidase__InfluenzaA__AFJ78704

SEQ ID NO: 205394 - RNA, 1410 nt, Artificial Sequence; identical to SEQ ID NO: 199762
  derived and/or modified sequence opt5 from neuraminidase__InfluenzaA__AFJ78714

SEQ ID NO: 205395 - RNA, 1410 nt, Artificial Sequence
  derived and/or modified sequence opt5 from neuraminidase__InfluenzaA__AFJ78724
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucacccugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuugaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcugacaggacucgauuguauccgcccuugcuucugggucgaacugauuagaggccggcccaaagagaacacgaucuggaccuccgggagcucuauuuccuuuuguggagugaauagcgacacaguuggcuggucuuggcccgauggggcugagcuuccuuucaccaucgacaaguga

SEQ ID NO: 205396 - RNA, 1410 nt, Artificial Sequence; identical to SEQ ID NO: 199762
  derived and/or modified sequence opt5 from neuraminidase__InfluenzaA__AFJ78734

SEQ ID NO: 205397 - RNA, 1410 nt, Artificial Sequence; identical to SEQ ID NO: 199762
  derived and/or modified sequence opt5 from neuraminidase__InfluenzaA__AFJ78744

SEQ ID NO: 205398 - RNA, 1410 nt, Artificial Sequence; identical to SEQ ID NO: 199762
  derived and/or modified sequence opt5 from neuraminidase__InfluenzaA__AFJ78754

SEQ ID NO: 205399 - RNA, 1410 nt, Artificial Sequence; identical to SEQ ID NO: 199762
  derived and/or modified sequence opt5 from neuraminidase__InfluenzaA__AFJ78764

SEQ ID NO: 205400 - RNA, 1410 nt, Artificial Sequence; identical to SEQ ID NO: 199762
  derived and/or modified sequence opt5 from neuraminidase__InfluenzaA__AFJ78774

SEQ ID NO: 205401 - RNA, 1410 nt, Artificial Sequence; identical to SEQ ID NO: 199762
  derived and/or modified sequence opt5 from neuraminidase__InfluenzaA__AFJ78784

SEQ ID NO: 205402 - RNA, 1410 nt, Artificial Sequence
  derived and/or modified sequence opt5 from neuraminidase__InfluenzaA__AFJ78794
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuggggagauuacaugcgugugcagagacaauuggcacggaagcaaccggcccuggguguccuucaaucagaaccuggaauaucagaucggcuacauuuguagcgggaucuuuggagauaauccucgccccaacgacaaaaccggcucuugcgggccggucuccagcaauggagccaacggcgugaagggcuucucuuuuaaguaugggaacggaguuuggauuggcagaacaaaauccaucagcucccggaauggguucgagaugauuugggauccuaacggauggaccggcaccgacaauaacuuuucuaucaagcaagacaucguggggauuaaugaauggagcggcuacuccggaucuuucguccagcaucccgagcuuacaggccuggauuguauccgcccuugcuucuggguggaacucauuagagggcggcccaaagagaacacgaucuggaccagcggauccagcauuucuuuuuguggcguuaauuccgacacagugggguggagcuggcccgauggagcugagcugccuuucaccaucgacaaguga

SEQ ID NO: 205403 - RNA, 1410 nt, Artificial Sequence; identical to SEQ ID NO: 199762
  derived and/or modified sequence opt5 from neuraminidase__InfluenzaA__AFJ78804

SEQ ID NO: 205404 - RNA, 1410 nt, Artificial Sequence; identical to SEQ ID NO: 199762
  derived and/or modified sequence opt5 from neuraminidase__InfluenzaA__AFJ78814

SEQ ID NO: 205405 - RNA, 1410 nt, Artificial Sequence; identical to SEQ ID NO: 199762
  derived and/or modified sequence opt5 from neuraminidase__InfluenzaA__AFJ78824

SEQ ID NO: 205406 - RNA, 1410 nt, Artificial Sequence; identical to SEQ ID NO: 199762
  derived and/or modified sequence opt5 from neuraminidase__InfluenzaA__AFJ78834

SEQ ID NO: 205407 - RNA, 1410 nt, Artificial Sequence; identical to SEQ ID NO: 199762
  derived and/or modified sequence opt5 from neuraminidase__InfluenzaA__AFJ78844

SEQ ID NO: 205408 - RNA, 1410 nt, Artificial Sequence; identical to SEQ ID NO: 202011
  derived and/or modified sequence opt5 from neuraminidase__InfluenzaA__AFJ78854

SEQ ID NO: 205409 - RNA, 1410 nt, Artificial Sequence; identical to SEQ ID NO: 199762
  derived and/or modified sequence opt5 from neuraminidase__InfluenzaA__AFJ78864

SEQ ID NO: 205410 - RNA, 1410 nt, Artificial Sequence; identical to SEQ ID NO: 199762
  derived and/or modified sequence opt5 from neuraminidase__InfluenzaA__AFJ78874

SEQ ID NO: 205411 - RNA, 1410 nt, Artificial Sequence; identical to SEQ ID NO: 199762
  derived and/or modified sequence opt5 from neuraminidase__InfluenzaA__AFJ78884

SEQ ID NO: 205412 - RNA, 1410 nt, Artificial Sequence; identical to SEQ ID NO: 199762
  derived and/or modified sequence opt5 from neuraminidase__InfluenzaA__AFJ78894

SEQ ID NO: 205413 - RNA, 1410 nt, Artificial Sequence; identical to SEQ ID NO: 199762
  derived and/or modified sequence opt5 from neuraminidase__InfluenzaA__AFJ78904

SEQ ID NO: 205414 - RNA, 1410 nt, Artificial Sequence; identical to SEQ ID NO: 199762
  derived and/or modified sequence opt5 from neuraminidase__InfluenzaA__AFJ78914

SEQ ID NO: 205415 - RNA, 1410 nt, Artificial Sequence
  derived and/or modified sequence opt5 from neuraminidase__InfluenzaA__AFJ78924
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuauguggacaucucuaacacaaauuucgcugccgggcagagcguggucuccgugaaacuugcgggaaacucuagccugugcccuguuuccggcugggcuauuuacagcaaggauaauucuaucagaaucggguccaaaggagacguguuugucauucgggagccguucaucagcuguucuccccucgaaugccgcaccuuuuuccugacacagggcgcccuucugaacgauaagcauuccaauggcaccauuaaagacagaagcccuuaucggacgcucaugucuugucccaucggggagauuccuucccccuacaacagccgcuuugaauccguggccuggucugcuagcgccugccacgauggaaucaacuggcugaccaucggcauuuccgggccugacaauggagcuguugccgugcugaaguauaacggcaucauuacagauaccaucaagagcuggagaaauaacauucuccggacacaagagucugagugugcgugcgucaauggguccuguuucaccgugaugacggacggaccgagcgauggccaggccucuuacaaaaucuuucgcaucgaaaagggcaaaauugucaagagcguggagaugaacgcucccaauuaucauuacgaagagugcuccuguuacccugacucuagcgagaucacaugcguuugcagagauaacuggcacggguccaaucggcccugggugagcuucaaccagaaucuggaauaucagauuggauacaucuguucuggcauuuuuggggacaacccucgccccaaugauaaaaccggauccugcggcccggugagcucuaacggggccaauggagucaagggcuucuccuuuaaguauggcaacgggguguggaucggaagaacaaaaagcauuuccucucggaacggcuucgagaugaucugggacccuaauggguggaccggaaccgacaacaauuuuagcaucaagcaagauauuguuggcaucaacgaaugguccggguacucuggcagcuucgugcagcaucccgagcuuacaggacuggacuguauucgcccuugcuucugggucgaacucaucagaggccggcccaaagagaauacgauuuggaccuccgggagcucuaucuccuuuuguggagugaacagcgauacaguuggcuggucuuggcccgacggggcugagcugccuuucaccaucgauaaguga

SEQ ID NO: 205416 - RNA, 1410 nt, Artificial Sequence
  derived and/or modified sequence opt5 from neuraminidase__InfluenzaA__AFJ97569
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacgagaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcgugaacggcuccuguuucaccgugaugacggaugggccgagcgacggacaggccucuuacaaaauuuuucgcaucgagaagggcaaaaucgucaagagcguugaaaugaaugcucccaacuaucauuacgaggagugcuccuguuacccugauucuagcgaaauuacaugcgugugcagagacaauuggcacggcuccaaccggcccugggugagcuucaaucagaaccuggaguaucagaucggguacauuuguucuggaaucuuuggcgauaauccucgccccaacgacaaaaccggguccugcggaccggucagcucuaauggcgccaacggggugaagggauucuccuuuaaguauggcaacggcguuuggauugggagaacaaaaagcaucuccucucggaauggauucgaaaugauuugggauccuaacggcuggaccgggaccgacaauaacuuuagcaucaagcaagacaucgugggaauuaaugagugguccggcuacucugggagcuucguccagcaucccgaacuuacaggccuggauuguauccgcccuugcuucuggguggagcucauuagaggacggcccaaagagaacacgaucuggaccuccggcagcucuauuuccuuuugugggguuaauagcgacacagugucuugguccuggcccgauggagcugaacugccuuucaccaucgacaaguga

SEQ ID NO: 205417 - RNA, 1410 nt, Artificial Sequence; identical to SEQ ID NO: 199752
  derived and/or modified sequence opt5 from neuraminidase__InfluenzaA__AFK14107

SEQ ID NO: 205418 - RNA, 1410 nt, Artificial Sequence; identical to SEQ ID NO: 199762
  derived and/or modified sequence opt5 from neuraminidase__InfluenzaA__AFK14117

SEQ ID NO: 205419 - RNA, 1410 nt, Artificial Sequence; identical to SEQ ID NO: 200529
  derived and/or modified sequence opt5 from neuraminidase__InfluenzaA__AFK14141

SEQ ID NO: 205420 - RNA, 1410 nt, Artificial Sequence
  derived and/or modified sequence opt5 from neuraminidase__InfluenzaA__AFK14150
augaaccccaaucagaagaucauuaccaucggcagcgugugcaugacaauugggauggccaaccugauccuccaaauuggaaauaucaucuccauuuggaucucucacagcauuagacugggcaaccagaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuauccggaucggguccaaaggagauguguuugucauucgcgagccguucaucagcuguucuccccucgaaugcagaaccuuuuuccugacacagggcgcccuucugaaugacaagcauuccaacggcaccauuaaagaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaguauaauggcauuaucacagacaccauuaagagcuggcggaacaauauccuccgcacacaggagucugagugugcgugcgugaacggguccuguuucaccgugaugacggauggaccgagcgacgaacaagccucuuacaaaauuuuuagaaucgagaagggcaaaaucgucaagagcguugaaaugaaugcucccaacuaucauuacgaggagugcuccuguuacccugauucuagcgaaauuacaugcgugugccgggacaauuggcacggcuccaaccgccccugggugagcuucaaucagaaccuggaguaucagaucggguacauuuguucuggaaucuuuggcgauaauccuagacccaacgacaaaaccggguccugcggaccggucagcucuaauggcgccaacggggugaagggauucuccuuuaaguauggcaacggcguuuggauugggcggacaaaaagcaucuccucucgcaauggauucgaaaugauuugggauccuaacggcuggaccgggaccgacaauaacuuuagcaucaagcaggacaucgugggaauuaaugagugguccggcuacucugggagcuucguccaacaucccgaacuuacaggccuggauuguaucagaccuugcuucuggguggagcucauucggggacgccccaaagagaacacgaucuggaccuccggcagcucuauuuccuuuugugggguuaauagcgacacagugggauggucuuggcccgauggcgcugaacugccuuucaccaucgacaaguga

SEQ ID NO: 205421 - RNA, 1410 nt, Artificial Sequence; identical to SEQ ID NO: 200345
  derived and/or modified sequence opt5 from neuraminidase__InfluenzaA__AFK14159

SEQ ID NO: 205422 - RNA, 1410 nt, Artificial Sequence; identical to SEQ ID NO: 199762
  derived and/or modified sequence opt5 from neuraminidase__InfluenzaA__AFK14168

SEQ ID NO: 205423 - RNA, 1410 nt, Artificial Sequence; identical to SEQ ID NO: 199762
  derived and/or modified sequence opt5 from neuraminidase__InfluenzaA__AFK14177

SEQ ID NO: 205424 - RNA, 1410 nt, Artificial Sequence
  derived and/or modified sequence opt5 from neuraminidase__InfluenzaA__AFK14186
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuucgaagagugcuccuguuacccugauucuagcgagauuacaugcgugugcagagacaauuggcacggguccaaccggcccugggugagcuuuaaucagaaccuggaauaccagaucggauauauuuguucuggcaucuucggggauaauccucgccccaacgacaaaaccggauccugcggcccggucagcucuaauggggccaacggagugaagggcuuuuccuucaaguacggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguauucuggcagcuucguccagcaucccgagcuuacaggacuggauuguauccgcccuugcuuuuggguggaacucauuagaggccggcccaaagagaacacgaucuggaccuccgggagcucuauuuccuucuguggaguuaauagcgacacagugggcuggucuuggcccgauggggcugagcugccuuuuaccaucgacaaguga

SEQ ID NO: 205425 - RNA, 1410 nt, Artificial Sequence; identical to SEQ ID NO: 201743
  derived and/or modified sequence opt5 from neuraminidase__InfluenzaA__AFK14195

SEQ ID NO: 205426 - RNA, 1410 nt, Artificial Sequence; identical to SEQ ID NO: 199762
  derived and/or modified sequence opt5 from neuraminidase__InfluenzaA__AFK14204

SEQ ID NO: 205427 - RNA, 1410 nt, Artificial Sequence; identical to SEQ ID NO: 201743
  derived and/or modified sequence opt5 from neuraminidase__InfluenzaA__AFK14213

SEQ ID NO: 205428 - RNA, 1410 nt, Artificial Sequence
  derived and/or modified sequence opt5 from neuraminidase__InfluenzaA__AFK14222
augaaccccaaucagaagaucauuaccaucggcagcgugugcaugacaauugggauggccaaccugauccuccaaauuggaaauaucaucuccauuuggaucucucacagcauuagacugggcaaccagaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuauccggaucggguccaaaggagauguguuugucauucgcgagccguucaucagcuguucuccccucgaaugcagaaccuuuuuccugacacagggcgcccuucugaaugacaagcauuccaacggcaccauuaaagaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaguauaauggcauuaucacagacaccauuaagagcuggcggaacaauauccuccgcacacaggagucugagugugcgugcgugaacggguccuguuucaccgugaugacggauggaccgagcgacggccaagccucuuacaaaauuuuuagaaucgaaaagggcaaaaucgucaagagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucgugggcauuaaugaaugguccggguacucuggcagcuucguccaacaucccgagcuuacaggacuggauuguaucagaccuugcuucuggguggaacucauucggggccgccccaaagagaacacgaucuggaccuccgggagcucuauuuccuuuuguggaguuaauagcgacacagugggcuggucuuggcccgauggggcugagcugccuuucaccaucgacaaguga

SEQ ID NO: 205429 - RNA, 1410 nt, Artificial Sequence; identical to SEQ ID NO: 200345
  derived and/or modified sequence opt5 from neuraminidase__InfluenzaA__AFK14231

SEQ ID NO: 205430 - RNA, 1410 nt, Artificial Sequence; identical to SEQ ID NO: 199762
  derived and/or modified sequence opt5 from neuraminidase__InfluenzaA__AFK14240

SEQ ID NO: 205431 - RNA, 1410 nt, Artificial Sequence; identical to SEQ ID NO: 200529
  derived and/or modified sequence opt5 from neuraminidase__InfluenzaA__AFK14249

SEQ ID NO: 205432 - RNA, 1410 nt, Artificial Sequence; identical to SEQ ID NO: 199762
  derived and/or modified sequence opt5 from neuraminidase__InfluenzaA__AFK14257

SEQ ID NO: 205433 - RNA, 1410 nt, Artificial Sequence; identical to SEQ ID NO: 199762
  derived and/or modified sequence opt5 from neuraminidase__InfluenzaA__AFK14266

SEQ ID NO: 205434 - RNA, 1410 nt, Artificial Sequence; identical to SEQ ID NO: 199762
  derived and/or modified sequence opt5 from neuraminidase__InfluenzaA__AFK14274

SEQ ID NO: 205435 - RNA, 1410 nt, Artificial Sequence
  derived and/or modified sequence opt5 from neuraminidase__InfluenzaA__AFK14281
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccgacgugaacaucucuaauacaaacuucgcugccgggcagagcguggucuccgugaaacuugcgggaaauucuagccugugcccuguuuccggcugggcuauuuauagcaaggauaacucuaucagaaucggguccaaaggagacguguuugucauucgggagccguucaucagcuguucuccccucgaaugccgcaccuuuuuccugacacagggcgcccuucugaaugauaagcauuccaacggcaccauuaaagacagaagcccuuaccggacgcucaugucuugucccaucggggaggugccuucccccuauaacagccgcuuugaauccguugccuggucugcuagcgccugccacgauggaauuaauuggcugaccaucggcaucuccgggccugacaacggagcuguggccguccugaaguacaauggcauuaucacagauaccauuaagagcuggagaaacaauauccuccggacacaagagucugagugugcgugcgugaacggguccuguuucaccgugaugacggacggaccgagcgauggccaggccucuuauaaaauuuuucgcaucgaaaagggcaaaaucgucaagagcguugagaugaaugcucccaacuaccauuaugaagagugcuccuguuacccugacucuagcgagauuacaugcgugugcagagauaauuggcacggguccaaccggcccugggugagcuucaaucagaaccuggaauaccagaucggauauauuuguucuggcaucuuuggggacaauccucgccccaacgauaaaaccggauccugcggcccggucagcucuaauggggccaacggagugaagggcuucuccuuuaaguacggcaacgggguuuggauuggaagaacaaaaagcaucuccucucggaauggcuucgagaugauuugggacccuaacggguggaccggaaccgacaauaacuuuagcaucaagcaagauaucgugggcauuaaugaaugguccggguauucuggcagcuucguccagcaucccgagcuuacaggacuggacuguauccgcccuugcuucuggguggaacucauuagaggccggcccaaagagaacacgaucuggaccuccgggagcucuauuuccuuuuguggaguuaauagcgauacagugggcuggucuuggcccgacggggcugagcugccuuucaccaucgauaaguga

SEQ ID NO: 205436 - RNA, 1410 nt, Artificial Sequence; identical to SEQ ID NO: 199762
  derived and/or modified sequence opt5 from neuraminidase__InfluenzaA__AFK14289

SEQ ID NO: 205437 - RNA, 1410 nt, Artificial Sequence; identical to SEQ ID NO: 200345
  derived and/or modified sequence opt5 from neuraminidase__InfluenzaA__AFK14298

SEQ ID NO: 205438 - RNA, 1410 nt, Artificial Sequence; identical to SEQ ID NO: 199762
  derived and/or modified sequence opt5 from neuraminidase__InfluenzaA__AFK14307

SEQ ID NO: 205439 - RNA, 1410 nt, Artificial Sequence; identical to SEQ ID NO: 201743
  derived and/or modified sequence opt5 from neuraminidase__InfluenzaA__AFK14316

SEQ ID NO: 205440 - RNA, 1410 nt, Artificial Sequence
  derived and/or modified sequence opt5 from neuraminidase__InfluenzaA__AFK14325
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaagaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 205441 - RNA, 1410 nt, Artificial Sequence; identical to SEQ ID NO: 199762
  derived and/or modified sequence opt5 from neuraminidase__InfluenzaA__AFK14334

SEQ ID NO: 205442 - RNA, 1410 nt, Artificial Sequence; identical to SEQ ID NO: 199762
  derived and/or modified sequence opt5 from neuraminidase__InfluenzaA__AFK14343

SEQ ID NO: 205443 - RNA, 1410 nt, Artificial Sequence; identical to SEQ ID NO: 199762
  derived and/or modified sequence opt5 from neuraminidase__InfluenzaA__AFK14352

SEQ ID NO: 205444 - RNA, 1410 nt, Artificial Sequence; identical to SEQ ID NO: 199762
  derived and/or modified sequence opt5 from neuraminidase__InfluenzaA__AFK14360

SEQ ID NO: 205445 - RNA, 1410 nt, Artificial Sequence; identical to SEQ ID NO: 199762
  derived and/or modified sequence opt5 from neuraminidase__InfluenzaA__AFK14369

SEQ ID NO: 205446 - RNA, 1410 nt, Artificial Sequence
  derived and/or modified sequence opt5 from neuraminidase__InfluenzaA__AFK14387
augaaccccaaucagaagaucauuaccaucggcagcgugugcaugacaauugggauggccaaccugauccuccaaauuggaaauaucacguccaucuggauuucucacagcauccagcugggcaaccagaaucagauugacaccuguaaccaauccgucaucacauacgagaauaacaccuggguuaaucagacauaugugaacauuucuaauaccaacuucgcugccgggcagagcguggucuccgugaaacuugcgggaaauucuagccugugcccuguuuccggcugggcuaucuacagcaaggauaacucuauuagaaucggguccaaaggagacguguuugucauccgggaaccguucauuagcuguucuccccucgagugccgcacauuuuuccugacccagggcgcccuucugaaugauaagcauuccaacggcacgaucaaagacagaagcccuuaucggacccucaugucuugucccauuggggaagugccuucccccuacaacagccgcuuugaguccguugccuggucugcuagcgccugccacgauggaaucaauuggcugacaauuggcaucuccgggccugacaacggagcuguggccguccugaaguauaauggcaucauuaccgauacaaucaagagcuggagaaacaauauucuccggacccaagaaucugagugugcgugcgugaacggguccuguuucacggugaugacagacggaccgagcgauggccaggccucuuacaaaaucuuucgcauugagaagggcaaaaucgucaagagcguugaaaugaaugcucccaacuaucauuacgaggaaugcuccuguuacccugacucuagcgagauuaccugcgugugcagagauaauuggcacggguccaaccggcccugggugagcuucaaucagaaccuggaguaucagaucggauacaucuguucuggcauuuuuggggacaauccucgccccaacgauaaaacaggauccugcggcccggucagcucuaauggggccaacggagugaagggcuucuccuuuaaguauggcaacgggguuuggaucggaagaaccaaaagcauuuccucucggaauggcuucgaaaugaucugggacccuaacggguggaccggaacagacaauaacuuuagcauuaagcaagauaucgugggcaucaaugagugguccggguacucuggcagcuucguccagcaucccgaacuuacgggacuggacuguauucgcccuugcuucuggguggagcucaucagaggccggcccaaagaaaacaccauuuggacauccgggagcucuaucuccuuuuguggaguuaauagcgauaccgugggcuggucuuggcccgacggggcugagcugccuuucacaauugauaaguga

SEQ ID NO: 205447 - RNA, 1410 nt, Artificial Sequence; identical to SEQ ID NO: 200345
  derived and/or modified sequence opt5 from neuraminidase__InfluenzaA__AFK14397

SEQ ID NO: 205448 - RNA, 1410 nt, Artificial Sequence; identical to SEQ ID NO: 199762
  derived and/or modified sequence opt5 from neuraminidase__InfluenzaA__AFK14406

SEQ ID NO: 205449 - RNA, 1410 nt, Artificial Sequence; identical to SEQ ID NO: 199762
  derived and/or modified sequence opt5 from neuraminidase__InfluenzaA__AFK14415

SEQ ID NO: 205450 - RNA, 1410 nt, Artificial Sequence; identical to SEQ ID NO: 199762
  derived and/or modified sequence opt5 from neuraminidase__InfluenzaA__AFK14424

SEQ ID NO: 205451 - RNA, 1410 nt, Artificial Sequence
  derived and/or modified sequence opt5 from neuraminidase__InfluenzaA__AFK14433
augaaccccaaucagaagaucauuaccaucggcagcgugugcaugauuaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 205452 - RNA, 1410 nt, Artificial Sequence; identical to SEQ ID NO: 199762
  derived and/or modified sequence opt5 from neuraminidase__InfluenzaA__AFK14442

SEQ ID NO: 205453 - RNA, 1410 nt, Artificial Sequence
  derived and/or modified sequence opt5 from neuraminidase__InfluenzaA__AFK14451
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggcguccgcuaaacuugccggaaauucuagccugugcccugucuccggcugggccauuuacagcaaggacaacucuaucagaaucggguccaaaggagauguguuuguuauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccgucgcuuggucugcuagcgccugccacgacggaauuaauuggcugaccaucggcaucuccgggccugauaacggagcgguggccguucugaaguauaauggcauuaucacagacaccauuaagagcuggagaaacaauauccuccggacacaagagucugagugugcuugcgugaacggguccuguuucaccgucaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcgugugcagagacaauuggcacggguccaaccggcccuggguuagcuucaaucagaaccuggaauaucagaucggauacauuuguucuggcaucuuuggggauaauccucgccccaacgacaaaaccggauccugcggcccggugagcucuaauggggccaacggagugaagggcuucuccuuuaaguauggcaacggggucuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguucagcaucccgagcuuacaggacuggauuguauccgcccuugcuucuggguggaacucauuagaggccggcccaaagagaacacgaucuggaccuccgggagcauuaucucuuuuuguggagucaauuccgacacagugggcuggagcuggcccgauggggcggagcugccuuucaccaucgacaaguga

SEQ ID NO: 205454 - RNA, 1410 nt, Artificial Sequence; identical to SEQ ID NO: 199762
  derived and/or modified sequence opt5 from neuraminidase__InfluenzaA__AFK14458

SEQ ID NO: 205455 - RNA, 1410 nt, Artificial Sequence; identical to SEQ ID NO: 199762
  derived and/or modified sequence opt5 from neuraminidase__InfluenzaA__AFK14467

SEQ ID NO: 205456 - RNA, 1410 nt, Artificial Sequence; identical to SEQ ID NO: 199762
  derived and/or modified sequence opt5 from neuraminidase__InfluenzaA__AFK14476

SEQ ID NO: 205457 - RNA, 1410 nt, Artificial Sequence; identical to SEQ ID NO: 202821
  derived and/or modified sequence opt5 from neuraminidase__InfluenzaA__AFK14485

SEQ ID NO: 205458 - RNA, 1410 nt, Artificial Sequence; identical to SEQ ID NO: 199762
  derived and/or modified sequence opt5 from neuraminidase__InfluenzaA__AFK14504

SEQ ID NO: 205459 - RNA, 1410 nt, Artificial Sequence; identical to SEQ ID NO: 199762
  derived and/or modified sequence opt5 from neuraminidase__InfluenzaA__AFK14514

SEQ ID NO: 205460 - RNA, 1410 nt, Artificial Sequence; identical to SEQ ID NO: 199762
  derived and/or modified sequence opt5 from neuraminidase__InfluenzaA__AFK14522

SEQ ID NO: 205461 - RNA, 1410 nt, Artificial Sequence; identical to SEQ ID NO: 199762
  derived and/or modified sequence opt5 from neuraminidase__InfluenzaA__AFK14529

SEQ ID NO: 205462 - RNA, 1410 nt, Artificial Sequence; identical to SEQ ID NO: 199762
  derived and/or modified sequence opt5 from neuraminidase__InfluenzaA__AFK14538

SEQ ID NO: 205463 - RNA, 1410 nt, Artificial Sequence; identical to SEQ ID NO: 202137
  derived and/or modified sequence opt5 from neuraminidase__InfluenzaA__AFK14547

SEQ ID NO: 205464 - RNA, 1410 nt, Artificial Sequence
  derived and/or modified sequence opt5 from neuraminidase__InfluenzaA__AFK14555
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcgugauuuccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 205465 - RNA, 1410 nt, Artificial Sequence; identical to SEQ ID NO: 199762
  derived and/or modified sequence opt5 from neuraminidase__InfluenzaA__AFK14564

SEQ ID NO: 205466 - RNA, 1410 nt, Artificial Sequence; identical to SEQ ID NO: 199762
  derived and/or modified sequence opt5 from neuraminidase__InfluenzaA__AFK14573

SEQ ID NO: 205467 - RNA, 1410 nt, Artificial Sequence
  derived and/or modified sequence opt5 from neuraminidase__InfluenzaA__AFK14579
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauguguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 205468 - RNA, 1410 nt, Artificial Sequence; identical to SEQ ID NO: 199762
  derived and/or modified sequence opt5 from neuraminidase__InfluenzaA__AFK14588

SEQ ID NO: 205469 - RNA, 1410 nt, Artificial Sequence; identical to SEQ ID NO: 199762
  derived and/or modified sequence opt5 from neuraminidase__InfluenzaA__AFK14597

SEQ ID NO: 205470 - RNA, 1410 nt, Artificial Sequence; identical to SEQ ID NO: 199762
  derived and/or modified sequence opt5 from neuraminidase__InfluenzaA__AFK14604

SEQ ID NO: 205471 - RNA, 1410 nt, Artificial Sequence; identical to SEQ ID NO: 199762
  derived and/or modified sequence opt5 from neuraminidase__InfluenzaA__AFK14632

SEQ ID NO: 205472 - RNA, 1410 nt, Artificial Sequence; identical to SEQ ID NO: 199752
  derived and/or modified sequence opt5 from neuraminidase__InfluenzaA__AFK14641

SEQ ID NO: 205473 - RNA, 1410 nt, Artificial Sequence; identical to SEQ ID NO: 199762
  derived and/or modified sequence opt5 from neuraminidase__InfluenzaA__AFK14651

SEQ ID NO: 205474 - RNA, 1410 nt, Artificial Sequence; identical to SEQ ID NO: 199762
  derived and/or modified sequence opt5 from neuraminidase__InfluenzaA__AFK14656

SEQ ID NO: 205475 - RNA, 1410 nt, Artificial Sequence; identical to SEQ ID NO: 199762
  derived and/or modified sequence opt5 from neuraminidase__InfluenzaA__AFK14663

SEQ ID NO: 205476 - RNA, 1410 nt, Artificial Sequence; identical to SEQ ID NO: 199762
  derived and/or modified sequence opt5 from neuraminidase__InfluenzaA__AFK14672

SEQ ID NO: 205477 - RNA, 1410 nt, Artificial Sequence; identical to SEQ ID NO: 199762
  derived and/or modified sequence opt5 from neuraminidase__InfluenzaA__AFK14680

SEQ ID NO: 205478 - RNA, 1410 nt, Artificial Sequence; identical to SEQ ID NO: 199762
  derived and/or modified sequence opt5 from neuraminidase__InfluenzaA__AFK14690

SEQ ID NO: 205479 - RNA, 1410 nt, Artificial Sequence; identical to SEQ ID NO: 199762
  derived and/or modified sequence opt5 from neuraminidase__InfluenzaA__AFK14707

SEQ ID NO: 205480 - RNA, 1410 nt, Artificial Sequence; identical to SEQ ID NO: 199762
  derived and/or modified sequence opt5 from neuraminidase__InfluenzaA__AFK14715

SEQ ID NO: 205481 - RNA, 1410 nt, Artificial Sequence; identical to SEQ ID NO: 199762
  derived and/or modified sequence opt5 from neuraminidase__InfluenzaA__AFK14724

SEQ ID NO: 205482 - RNA, 1410 nt, Artificial Sequence; identical to SEQ ID NO: 199762
  derived and/or modified sequence opt5 from neuraminidase__InfluenzaA__AFK14733

SEQ ID NO: 205483 - RNA, 1410 nt, Artificial Sequence; identical to SEQ ID NO: 199762
  derived and/or modified sequence opt5 from neuraminidase__InfluenzaA__AFK14751

SEQ ID NO: 205484 - RNA, 1410 nt, Artificial Sequence; identical to SEQ ID NO: 199762
  derived and/or modified sequence opt5 from neuraminidase__InfluenzaA__AFK14757

SEQ ID NO: 205485 - RNA, 1410 nt, Artificial Sequence; identical to SEQ ID NO: 199762
  derived and/or modified sequence opt5 from neuraminidase__InfluenzaA__AFK14766

SEQ ID NO: 205486 - RNA, 1410 nt, Artificial Sequence; identical to SEQ ID NO: 200345
  derived and/or modified sequence opt5 from neuraminidase__InfluenzaA__AFK14774

SEQ ID NO: 205487 - RNA, 1410 nt, Artificial Sequence; identical to SEQ ID NO: 205464
  derived and/or modified sequence opt5 from neuraminidase__InfluenzaA__AFK14781

SEQ ID NO: 205488 - RNA, 1410 nt, Artificial Sequence; identical to SEQ ID NO: 200345
  derived and/or modified sequence opt5 from neuraminidase__InfluenzaA__AFK14790

SEQ ID NO: 205489 - RNA, 1410 nt, Artificial Sequence
  derived and/or modified sequence opt5 from neuraminidase__InfluenzaA__AFK14800
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggccccgcgagaacacgaucuggaccuccgggagcucuauuuccuuuuguggaguuaauagcgacacagugggcuggucuuggcccgauggggcugagcugccuuucaccaucgacaaauga

SEQ ID NO: 205490 - RNA, 1410 nt, Artificial Sequence; identical to SEQ ID NO: 201743
  derived and/or modified sequence opt5 from neuraminidase__InfluenzaA__AFK14809

SEQ ID NO: 205491 - RNA, 1410 nt, Artificial Sequence; identical to SEQ ID NO: 201743
  derived and/or modified sequence opt5 from neuraminidase__InfluenzaA__AFK14816

SEQ ID NO: 205492 - RNA, 1410 nt, Artificial Sequence; identical to SEQ ID NO: 199762
  derived and/or modified sequence opt5 from neuraminidase__InfluenzaA__AFK14824

SEQ ID NO: 205493 - RNA, 1410 nt, Artificial Sequence; identical to SEQ ID NO: 199762
  derived and/or modified sequence opt5 from neuraminidase__InfluenzaA__AFK14841

SEQ ID NO: 205494 - RNA, 1410 nt, Artificial Sequence; identical to SEQ ID NO: 200835
  derived and/or modified sequence opt5 from neuraminidase__InfluenzaA__AFK14849

SEQ ID NO: 205495 - RNA, 1410 nt, Artificial Sequence
  derived and/or modified sequence opt5 from neuraminidase__InfluenzaA__AFK14856
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuuaagauugaaaaaggcaagaucguuaaaagcguggagaugaacgcucccaauuaucauuacgaagagugcuccuguuacccugacucuagcgagaucacaugcgugugccgcgauaacuggcacggguccaauagacccugggucagcuucaaccagaaucuggaauaucagauuggauacaucuguucuggcauuuuuggggacaacccucggcccaucgauaagaccggauccugcggcccggugagcucuaauggggccaacggaguuaagggcuucuccuuuaaauauggcaacgggguguggauuggacgcacaaagagcaucuccucuagaaauggcuucgagaugauuugggacccuaacggguggaccggaaccgauaauaacuuuagcaucaaacaagacaucgucggcauuaaugaaugguccggguacucuggcagcuucgugcagcaucccgagcuuacaggacuggacuguauccggccuugcuucuggguugaacucauucgcggcagacccaaggagaacacgaucuggaccuccgggagcucuauuuccuuuuguggagugaauagcgauacagucggcuggucuuggcccgacggggcugagcugccuuucaccaucgauaaauga

SEQ ID NO: 205496 - RNA, 1410 nt, Artificial Sequence; identical to SEQ ID NO: 199762
  derived and/or modified sequence opt5 from neuraminidase__InfluenzaA__AFK14870

SEQ ID NO: 205497 - RNA, 1410 nt, Artificial Sequence; identical to SEQ ID NO: 199762
  derived and/or modified sequence opt5 from neuraminidase__InfluenzaA__AFK14879

SEQ ID NO: 205498 - RNA, 1410 nt, Artificial Sequence; identical to SEQ ID NO: 199762
  derived and/or modified sequence opt5 from neuraminidase__InfluenzaA__AFK14885

SEQ ID NO: 205499 - RNA, 1410 nt, Artificial Sequence; identical to SEQ ID NO: 199762
  derived and/or modified sequence opt5 from neuraminidase__InfluenzaA__AFK14894

SEQ ID NO: 205500 - RNA, 1410 nt, Artificial Sequence; identical to SEQ ID NO: 199762
  derived and/or modified sequence opt5 from neuraminidase__InfluenzaA__AFK14903

SEQ ID NO: 205501 - RNA, 1410 nt, Artificial Sequence; identical to SEQ ID NO: 199762
  derived and/or modified sequence opt5 from neuraminidase__InfluenzaA__AFK14912

SEQ ID NO: 205502 - RNA, 1410 nt, Artificial Sequence; identical to SEQ ID NO: 199762
  derived and/or modified sequence opt5 from neuraminidase__InfluenzaA__AFK14921

SEQ ID NO: 205503 - RNA, 1410 nt, Artificial Sequence; identical to SEQ ID NO: 199762
  derived and/or modified sequence opt5 from neuraminidase__InfluenzaA__AFK14931

SEQ ID NO: 205504 - RNA, 1410 nt, Artificial Sequence
  derived and/or modified sequence opt5 from neuraminidase__InfluenzaA__AFK25604
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuauuacuacgaagagugcucuuguuauccugauagcuccgagaucacaugcguuugccgggacaacuggcauggcagcaaucgccccugggugucuuucaaccagaaucuggaauaccagauuggguauaucuguuccggaauuuuuggcgauaacccuagacccaaugacaaaaccgggagcugcggaccggugucuuccaacggcgccaauggggucaagggauucagcuuuaaguacggcaacggcguguggaucgggcggacaaaauccauuucuagccgcaagggauucgagaugaucugggauccuaacggcuggaccgggaccgacaauaacuuuuccaucaaacaagacauuguuggaaucaaugaauggucuggcuauagcggguccuucgugcagcaccccgagcuuacaggccuggauuguauuagaccuugcuucugggucgaacucauccggggacgccccaaggagaacacgauuuggaccagcggcuccuccaucagcuuuugugggguuaauucugacacagugggaugguccuggcccgauggcgcugagcugccuuucaccaucgacaaauga

SEQ ID NO: 205505 - RNA, 1410 nt, Artificial Sequence; identical to SEQ ID NO: 205504
  derived and/or modified sequence opt5 from neuraminidase__InfluenzaA__AFK25606

SEQ ID NO: 205506 - RNA, 1410 nt, Artificial Sequence; identical to SEQ ID NO: 201113
  derived and/or modified sequence opt5 from neuraminidase__InfluenzaA__AFK74537

SEQ ID NO: 205507 - RNA, 1410 nt, Artificial Sequence; identical to SEQ ID NO: 199762
  derived and/or modified sequence opt5 from neuraminidase__InfluenzaA__AFK74547

SEQ ID NO: 205508 - RNA, 1410 nt, Artificial Sequence; identical to SEQ ID NO: 202754
  derived and/or modified sequence opt5 from neuraminidase__InfluenzaA__AFK74557

SEQ ID NO: 205509 - RNA, 1410 nt, Artificial Sequence; identical to SEQ ID NO: 199762
  derived and/or modified sequence opt5 from neuraminidase__InfluenzaA__AFK74567

SEQ ID NO: 205510 - RNA, 1410 nt, Artificial Sequence; identical to SEQ ID NO: 199762
  derived and/or modified sequence opt5 from neuraminidase__InfluenzaA__AFK74578

SEQ ID NO: 205511 - RNA, 1410 nt, Artificial Sequence; identical to SEQ ID NO: 204877
  derived and/or modified sequence opt5 from neuraminidase__InfluenzaA__AFK74588

SEQ ID NO: 205512 - RNA, 1410 nt, Artificial Sequence; identical to SEQ ID NO: 199762
  derived and/or modified sequence opt5 from neuraminidase__InfluenzaA__AFK74598

SEQ ID NO: 205513 - RNA, 1410 nt, Artificial Sequence; identical to SEQ ID NO: 199762
  derived and/or modified sequence opt5 from neuraminidase__InfluenzaA__AFK74608

SEQ ID NO: 205514 - RNA, 1410 nt, Artificial Sequence; identical to SEQ ID NO: 199762
  derived and/or modified sequence opt5 from neuraminidase__InfluenzaA__AFK74618

SEQ ID NO: 205515 - RNA, 1410 nt, Artificial Sequence; identical to SEQ ID NO: 199762
  derived and/or modified sequence opt5 from neuraminidase__InfluenzaA__AFK74628

SEQ ID NO: 205516 - RNA, 1410 nt, Artificial Sequence; identical to SEQ ID NO: 199762
  derived and/or modified sequence opt5 from neuraminidase__InfluenzaA__AFK74638

SEQ ID NO: 205517 - RNA, 1410 nt, Artificial Sequence; identical to SEQ ID NO: 199762
  derived and/or modified sequence opt5 from neuraminidase__InfluenzaA__AFK74648

SEQ ID NO: 205518 - RNA, 1410 nt, Artificial Sequence; identical to SEQ ID NO: 204886
  derived and/or modified sequence opt5 from neuraminidase__InfluenzaA__AFK74658

SEQ ID NO: 205519 - RNA, 1410 nt, Artificial Sequence; identical to SEQ ID NO: 204886
  derived and/or modified sequence opt5 from neuraminidase__InfluenzaA__AFK74668

SEQ ID NO: 205520 - RNA, 1410 nt, Artificial Sequence; identical to SEQ ID NO: 199762
  derived and/or modified sequence opt5 from neuraminidase__InfluenzaA__AFK74678

SEQ ID NO: 205521 - RNA, 1410 nt, Artificial Sequence; identical to SEQ ID NO: 199762
  derived and/or modified sequence opt5 from neuraminidase__InfluenzaA__AFK74688

SEQ ID NO: 205522 - RNA, 1410 nt, Artificial Sequence; identical to SEQ ID NO: 199762
  derived and/or modified sequence opt5 from neuraminidase__InfluenzaA__AFK74698

SEQ ID NO: 205523 - RNA, 1410 nt, Artificial Sequence; identical to SEQ ID NO: 204893
  derived and/or modified sequence opt5 from neuraminidase__InfluenzaA__AFK74708

SEQ ID NO: 205524 - RNA, 1410 nt, Artificial Sequence; identical to SEQ ID NO: 202754
  derived and/or modified sequence opt5 from neuraminidase__InfluenzaA__AFK74718

SEQ ID NO: 205525 - RNA, 1410 nt, Artificial Sequence; identical to SEQ ID NO: 199762
  derived and/or modified sequence opt5 from neuraminidase__InfluenzaA__AFK74728

SEQ ID NO: 205526 - RNA, 1410 nt, Artificial Sequence; identical to SEQ ID NO: 199762
  derived and/or modified sequence opt5 from neuraminidase__InfluenzaA__AFK74738

SEQ ID NO: 205527 - RNA, 1410 nt, Artificial Sequence; identical to SEQ ID NO: 199762
  derived and/or modified sequence opt5 from neuraminidase__InfluenzaA__AFK74748

SEQ ID NO: 205528 - RNA, 1410 nt, Artificial Sequence; identical to SEQ ID NO: 199762
  derived and/or modified sequence opt5 from neuraminidase__InfluenzaA__AFK74758

SEQ ID NO: 205529 - RNA, 1410 nt, Artificial Sequence; identical to SEQ ID NO: 199762
  derived and/or modified sequence opt5 from neuraminidase__InfluenzaA__AFK74768

SEQ ID NO: 205530 - RNA, 1410 nt, Artificial Sequence; identical to SEQ ID NO: 199762
  derived and/or modified sequence opt5 from neuraminidase__InfluenzaA__AFK74778

SEQ ID NO: 205531 - RNA, 1410 nt, Artificial Sequence; identical to SEQ ID NO: 202754
  derived and/or modified sequence opt5 from neuraminidase__InfluenzaA__AFK74788

SEQ ID NO: 205532 - RNA, 1410 nt, Artificial Sequence; identical to SEQ ID NO: 202754
  derived and/or modified sequence opt5 from neuraminidase__InfluenzaA__AFK74798

SEQ ID NO: 205533 - RNA, 1410 nt, Artificial Sequence; identical to SEQ ID NO: 202754
  derived and/or modified sequence opt5 from neuraminidase__InfluenzaA__AFK74808

SEQ ID NO: 205534 - RNA, 1410 nt, Artificial Sequence; identical to SEQ ID NO: 202754
  derived and/or modified sequence opt5 from neuraminidase__InfluenzaA__AFK74818

SEQ ID NO: 205535 - RNA, 1410 nt, Artificial Sequence; identical to SEQ ID NO: 199762
  derived and/or modified sequence opt5 from neuraminidase__InfluenzaA__AFK74828

SEQ ID NO: 205536 - RNA, 1410 nt, Artificial Sequence; identical to SEQ ID NO: 201653
  derived and/or modified sequence opt5 from neuraminidase__InfluenzaA__AFK74838

SEQ ID NO: 205537 - RNA, 1410 nt, Artificial Sequence; identical to SEQ ID NO: 199762
  derived and/or modified sequence opt5 from neuraminidase__InfluenzaA__AFK74848

SEQ ID NO: 205538 - RNA, 1410 nt, Artificial Sequence; identical to SEQ ID NO: 199762
  derived and/or modified sequence opt5 from neuraminidase__InfluenzaA__AFK74898

SEQ ID NO: 205539 - RNA, 1410 nt, Artificial Sequence; identical to SEQ ID NO: 199762
  derived and/or modified sequence opt5 from neuraminidase__InfluenzaA__AFK74908

SEQ ID NO: 205540 - RNA, 1410 nt, Artificial Sequence; identical to SEQ ID NO: 199762
  derived and/or modified sequence opt5 from neuraminidase__InfluenzaA__AFK74918

SEQ ID NO: 205541 - RNA, 1410 nt, Artificial Sequence; identical to SEQ ID NO: 199762
  derived and/or modified sequence opt5 from neuraminidase__InfluenzaA__AFK74928

SEQ ID NO: 205542 - RNA, 1410 nt, Artificial Sequence
  derived and/or modified sequence opt5 from neuraminidase__InfluenzaA__AFK74938
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaauaccggauccugcggcccggucagcucuaacggggccaacggagugaaaggcuucuccuuuaaguauggcaaugggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 205543 - RNA, 1410 nt, Artificial Sequence; identical to SEQ ID NO: 199762
  derived and/or modified sequence opt5 from neuraminidase__InfluenzaA__AFK74948

SEQ ID NO: 205544 - RNA, 1410 nt, Artificial Sequence; identical to SEQ ID NO: 201653
  derived and/or modified sequence opt5 from neuraminidase__InfluenzaA__AFK74958

SEQ ID NO: 205545 - RNA, 1410 nt, Artificial Sequence; identical to SEQ ID NO: 202754
  derived and/or modified sequence opt5 from neuraminidase__InfluenzaA__AFK74968

SEQ ID NO: 205546 - RNA, 1410 nt, Artificial Sequence; identical to SEQ ID NO: 199762
  derived and/or modified sequence opt5 from neuraminidase__InfluenzaA__AFK74978

SEQ ID NO: 205547 - RNA, 1410 nt, Artificial Sequence; identical to SEQ ID NO: 201653
  derived and/or modified sequence opt5 from neuraminidase__InfluenzaA__AFK74988

SEQ ID NO: 205548 - RNA, 1410 nt, Artificial Sequence; identical to SEQ ID NO: 199762
  derived and/or modified sequence opt5 from neuraminidase__InfluenzaA__AFK74998

SEQ ID NO: 205549 - RNA, 1410 nt, Artificial Sequence; identical to SEQ ID NO: 202754
  derived and/or modified sequence opt5 from neuraminidase__InfluenzaA__AFK75008

SEQ ID NO: 205550 - RNA, 1410 nt, Artificial Sequence; identical to SEQ ID NO: 199762
  derived and/or modified sequence opt5 from neuraminidase__InfluenzaA__AFK75018

SEQ ID NO: 205551 - RNA, 1410 nt, Artificial Sequence; identical to SEQ ID NO: 199762
  derived and/or modified sequence opt5 from neuraminidase__InfluenzaA__AFK75028

SEQ ID NO: 205552 - RNA, 1410 nt, Artificial Sequence; identical to SEQ ID NO: 199762
  derived and/or modified sequence opt5 from neuraminidase__InfluenzaA__AFK75038

SEQ ID NO: 205553 - RNA, 1410 nt, Artificial Sequence; identical to SEQ ID NO: 199762
  derived and/or modified sequence opt5 from neuraminidase__InfluenzaA__AFK75048

SEQ ID NO: 205554 - RNA, 1410 nt, Artificial Sequence; identical to SEQ ID NO: 199762
  derived and/or modified sequence opt5 from neuraminidase__InfluenzaA__AFK75058

SEQ ID NO: 205555 - RNA, 1410 nt, Artificial Sequence; identical to SEQ ID NO: 202754
  derived and/or modified sequence opt5 from neuraminidase__InfluenzaA__AFK75068

SEQ ID NO: 205556 - RNA, 1410 nt, Artificial Sequence; identical to SEQ ID NO: 199762
  derived and/or modified sequence opt5 from neuraminidase__InfluenzaA__AFK75078

SEQ ID NO: 205557 - RNA, 1410 nt, Artificial Sequence; identical to SEQ ID NO: 199762
  derived and/or modified sequence opt5 from neuraminidase__InfluenzaA__AFK75088

SEQ ID NO: 205558 - RNA, 1410 nt, Artificial Sequence; identical to SEQ ID NO: 199762
  derived and/or modified sequence opt5 from neuraminidase__InfluenzaA__AFK75098

SEQ ID NO: 205559 - RNA, 1410 nt, Artificial Sequence; identical to SEQ ID NO: 201675
  derived and/or modified sequence opt5 from neuraminidase__InfluenzaA__AFK75108

SEQ ID NO: 205560 - RNA, 1410 nt, Artificial Sequence; identical to SEQ ID NO: 199762
  derived and/or modified sequence opt5 from neuraminidase__InfluenzaA__AFK77860

SEQ ID NO: 205561 - RNA, 1410 nt, Artificial Sequence; identical to SEQ ID NO: 199762
  derived and/or modified sequence opt5 from neuraminidase__InfluenzaA__AFK77870

SEQ ID NO: 205562 - RNA, 1410 nt, Artificial Sequence; identical to SEQ ID NO: 199762
  derived and/or modified sequence opt5 from neuraminidase__InfluenzaA__AFK77880

SEQ ID NO: 205563 - RNA, 1410 nt, Artificial Sequence
  derived and/or modified sequence opt5 from neuraminidase__InfluenzaA__AFK77890
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaggcaucagcucccggaauggguucgagaugauuugggauccuaacggauggaccggcaccgacaauaacuuuucuaucaagcaagacaucguggggauuaaugaauggagcggcuacuccggaucuuucguccagcaucccgagcuuacaggccuggauuguauccgcccuugcuucuggguggaacucauuagagggcggcccaaagagaacacgaucuggaccagcggauccagcauuucuuuuuguggcguuaauuccgacacagugggguggagcuggcccgauggagcugagcugccuuucaccaucgacaaguga

SEQ ID NO: 205564 - RNA, 1410 nt, Artificial Sequence
  derived and/or modified sequence opt5 from neuraminidase__InfluenzaA__AFK77900
augaaccccaaucagaagaucauuaccaucggcagcgugugcaugacaauugggauggccaaccugauccuccaaauuggaaauaucaucuccauuuggaucucucacagcauucagaucggcaaccagaaucagauugagacguguaaccaauccgucaucaccuacgaaaauaacacauggguuaaucagaccuaugugaacauuucuaauacaaacuucgcugccgggcagagcguggcguccgucaaacuggcuggaaauucuagccuuugcccuguguccggcugggccaucuacagcaaggacaacucuaucagaauuggguccaaaggagauguuuuugugauccgggagccguucauuagcuguucuccccuggaaugccgcaccuuuuuccucacacagggcgcccugcuuaaugacaagcauuccaacggcaccaucaaagauagaagcccuuaucgggcucugaugucuugucccauuggggaggucccuucccccuacaacagccgcuuugaauccguggccuggucugcuagcgccugccacgacggaaucaauuggcucacgaucggcauuuccgggccugauaacggagcgguugccgugcugaaguauaauggcaucauuaccgacacaaucaagagcuggagaaacaauauucugcggacccaagagucugagugugcuugcgucaacggguccuguuucacaaucaugaccgauggaccgagcgacggccaggccucuuacaaaaucuuucgcauugaaaagggcaaaaucgucaagagcguggagaugaaugcucccaacuaucauuacgaagagugcuccuguuacccugauucuagcgagauuacgugcgugugcagagacaauuggcacggguccaaccggcccuggguuagcuucaaucagaaccucgaauaucagaucggauacauuuguucuggcaucuuuggggauaauccucgccccaacgacaaaacaggauccugcggcccggugagcucuaauggggccaacggagugaagggcuucuccuuuaaguauggcaacggggucuggauuggaagaaccaaaagcaucuccucucggaagggcuucgagaugaucugggauccuaauggguggacaggaaccgacaacaauuuuagcauuaaacaagacaucgugggcaugaacgaaugguccggguacucuggcagcuucguucagcaucccgagcugaccggacuugauuguauucgcccuugcuucuggguggaacugaucagaggccggcccaaggagaauacaauuuggacguccgggagcucuaucuccuuuuguggagucaacagcgacaccgugggcuggucuuggcccgauggggcggagcucccuuucacaaucgacaaauga

SEQ ID NO: 205565 - RNA, 1410 nt, Artificial Sequence
  derived and/or modified sequence opt5 from neuraminidase__InfluenzaA__AFK78031
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggcguccgucaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucgggcucucaugucuugucccaucggggaggucccuucccccuacaacagccgcuuugaauccguggccuggucugcuagcgccugccacgacggaauuaauuggcugacgaucggcaucuccgggccugauaacggagcgguugccgugcugaaguauaauggcauuaucaccgacacaauuaagagcuggagaaacaauauccuccggacccaagagucugagugugcuugcgucaacggguccuguuucacaauuaugaccgauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacgugcgugugcagagacaauuggcacggguccaaccggcccuggguuagcuucaaucagaaccuggaauaucagauuggauacaucuguucuggcauuuuuggggauaauccucgccccaacgacaaaacaggauccugcggcccggugagcucuaauggggccaacggagugaagggcuucuccuuuaaguauggcaacggggucuggaucggaagaaccaaaagcauuuccucucggaagggcuucgagaugaucugggauccuaauggguggacaggaaccgacaacaauuuuagcaucaaacaagacauugugggcaugaacgaaugguccggguacucuggcagcuucguucagcaucccgagcuuaccggacuggauuguauccgcccuugcuucuggguggaacucauuagaggccggcccaaggagaauacaaucuggacguccgggagcucuauuuccuuuuguggagucaacagcgacaccgugggcuggucuuggcccgauggggcggagcugccuuucacaaucgacaaauga

SEQ ID NO: 205566 - RNA, 1410 nt, Artificial Sequence; identical to SEQ ID NO: 199762
  derived and/or modified sequence opt5 from neuraminidase__InfluenzaA__AFK78190

SEQ ID NO: 205567 - RNA, 1362 nt, Artificial Sequence
  derived and/or modified sequence opt5 from neuraminidase__InfluenzaA__AFM68957
augaaccccaaucagaagaucauuaccaucggcagcauuugcaugguggucgggaucauuucccugauccuccaaaucggaaacauuaucucuauuuggaucagccacuccauucagacaggcaaucagaaccauacggggaucuguaaucagggaauuaucacccacaacguuguggccggccaagacucuacaagcgugauccugaccggaaauuccucucuuugcccuauuagaggaugggcuauccauagcaaagauaacggcauucggaucggcuccaagggggacgucuucgugauucgcgagccguuuaucagcuguucucaccuggaaugcagaacauucuuucucacccagggagcccugcuuaaugauaaacauuccuacggcacaagcaaggaccggucucccuaucgcgcgcugauguccuguccuguuggggaggcucccagcccuuacaacucuagauucgaauccguggccuggagcgccuccgcuugccacgauggaaugggcuggcucaccaucgggauuucuggacccgacaauggcgccgucgcugugcugaaauauaacggcaucauuacggagaccaucaagagcuggcggaagaaaauucugcgcacacaggaauccgaguguaccugcguuaaugggagcuguuuuacaaucaugaccgauggaccuucugacggccucgccuccuacaagaucuucaaaauugagaaggggaaagugacgaagucuaucgaacugaacgcgccgaauagccacuaugaggaaugcagcuguuaccccgauacaggaaaggucaugugcgugugcagagacaacuggcauggcuccaaccggccuugggugucuuuugaucagaaucuugacuaucaaauuggguacaucuguagcggagucuucggcgauaacccccgcccuaaagacggcaccggguccugcggacccguuagcgccgacggcgcuaauggggugaagggauuuucuuacagauauggcaacgggguguggauuggccggacaaaauccgauagcucucgccacggauucgagaugaucugggacccgaauggcuggaccgagaccgauuccagauuuagcguccggcaggacgugguugccaugacagaucgcuccggguacucugggagcuucgugcagcauccugaacugacgggccucgacuguaugagacccugcuuuugggucgagcugauucgggggcagccugaagaggaaaccaucuggacauccggaucuaucauuagcuucuguggcgugaacuccgauaccguugacuggagcuggcccgauggggcugagcuucccuucacaaucgacaaguga

SEQ ID NO: 205568 - RNA, 1410 nt, Artificial Sequence
  derived and/or modified sequence opt5 from neuraminidase__InfluenzaA__AFM68968
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuugguccaagaacauucugcgcacccaggagagcgaaugcgucuguaucaaugggaccugcacaguggugaugacggauggcucugccuccgagagagcggacaccaaaauccucuuuauugaggaaggaaagaucguccacauuagcccucuguccggcucugcccaacauguugaggaaugcagcuguuauccccgguacccuggggugcgcugcguguguagagauaacuggaagggauccaaucggcccaucgucgacauuaacgugaaagacuacagcaucgcuucuuccuauguuugcagcggccuugugggcgauacaccgcgcaagaacgacagaucuagcuccucuuacugucggaauccuaacaaugagaaagggaaccacggagucaagggcugggccuucgaugacgggaaugauguguggaugggacgcaccaucagcgaagaguccagaagcggcuaugagacauuuaaaguuauugggggauggucuacccccaacuccaagcugcagaucaauagacaggugauugucgacagcgauaaccggucuggcuacuccggcaucuucagcguggaagggaaauccugcauuaaucgcuguuuuuaugucgagcucauccggggaagagaacaggagacgcgcgugugguggacaucuaacagcauuguuguguucugcggcaccuccgggaccuacggaacaggcucuuggccugacggggcugauaucaaucugaugcccaucuga

SEQ ID NO: 205569 - RNA, 1410 nt, Artificial Sequence
  derived and/or modified sequence opt5 from neuraminidase__InfluenzaA__AFM68979
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgggaucugggugaccagagagccuuauguuucuugugauccgggaaagugcuaccaauucgcucuuggccaggggacaacccuggacaacaaacauagcaaugauacaauucacgaccggacccccuaucgcacgcuccugaugaacgaacugggagugccuuuucaucucggcacaagacaggucuguaucgccugguccuccucuuccugccacgauggcaaggccuggcugcauguguguguuaccggguacgacaaaaaugcuacagccagcuucauuuaugauggacggcuuguggacucuaucggcuccuggagcaagaacauucugcgcacccaggagucugaaugcgucuguaucaaugggaccugcacaguggugaugacggauggauccgcuagcgagagagccgacaccaaaauccucuuuauugaggaaggcaagaucguccacauuagcccccugucugggagcgcgcaacacguugaggaaugcuccuguuacccucgguaccccggagugcgcugcguguguagagauaacuggaagggcagcaaucggccggucguggacaucaacguuaaagauuauucuauuguguccagcuacgucugcucuggccuugugggggacacaccucgcaagaacgacagaagcuccucuagcuauugucggaaucccaacaaugagaaaggaaaccauggcguuaaggggugggccuucgaugacggaaaugauguguggaugggccgcaccaucuccgaagagagcagaucuggguacgagacauuuaaagucaucggaggcugguccaccccuaacagcaagcugcagauuaauagacaggugaucgucgacucugauaaccgguccggcuauagcgggauuuucuccguggaaggaaaaucuugcaucaaucgcuguuuuuacguugagcucauucggggcagagaacaggagacgcgcgugugguggacaagcaacuccaucgucguguucugcgggaccucuggaaccuauggcacagggagcuggcccgacggcgcugauauuaaucugaugcccaucuga

SEQ ID NO: 205570 - RNA, 1410 nt, Artificial Sequence; identical to SEQ ID NO: 205569
  derived and/or modified sequence opt5 from neuraminidase__InfluenzaA__AFM68990

SEQ ID NO: 205571 - RNA, 1410 nt, Artificial Sequence; identical to SEQ ID NO: 197837
  derived and/or modified sequence opt5 from neuraminidase__InfluenzaA__AFM71723

SEQ ID NO: 205572 - RNA, 1410 nt, Artificial Sequence; identical to SEQ ID NO: 205159
  derived and/or modified sequence opt5 from neuraminidase__InfluenzaA__AFM71734

SEQ ID NO: 205573 - RNA, 1410 nt, Artificial Sequence; identical to SEQ ID NO: 204973
  derived and/or modified sequence opt5 from neuraminidase__InfluenzaA__AFM71745

SEQ ID NO: 205574 - RNA, 1410 nt, Artificial Sequence; identical to SEQ ID NO: 201633
  derived and/or modified sequence opt5 from neuraminidase__InfluenzaA__AFM71771

SEQ ID NO: 205575 - RNA, 1410 nt, Artificial Sequence; identical to SEQ ID NO: 204659
  derived and/or modified sequence opt5 from neuraminidase__InfluenzaA__AFM71782

SEQ ID NO: 205576 - RNA, 1410 nt, Artificial Sequence; identical to SEQ ID NO: 204659
  derived and/or modified sequence opt5 from neuraminidase__InfluenzaA__AFM71794

SEQ ID NO: 205577 - RNA, 1410 nt, Artificial Sequence; identical to SEQ ID NO: 199623
  derived and/or modified sequence opt5 from neuraminidase__InfluenzaA__AFM71805

SEQ ID NO: 205578 - RNA, 1410 nt, Artificial Sequence
  derived and/or modified sequence opt5 from neuraminidase__InfluenzaA__AFM71827
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaaggauguuuggaugggacgcaccaucagcgagaaaucuagacucggcuaugagacauuuaaggugaucgaagggugguccaacccuaaaagcaagcugcagauuaaucggcaggucaucguggaccgcggaaacagaucuggcuacuccggcauuuucagcgucgaggggaaguccuguaucaaucggugcuuuuauguggaacugauuagaggacgcaaagaggaaaccgagguucucuggaccucuaacagcaucguggucuucuguggcacauccgggaccuacggaacaggcucuuggcccgauggggcugacauuaaucugaugccuaucuga

SEQ ID NO: 205579 - RNA, 1410 nt, Artificial Sequence; identical to SEQ ID NO: 202542
  derived and/or modified sequence opt5 from neuraminidase__InfluenzaA__AFM71838

SEQ ID NO: 205580 - RNA, 1365 nt, Artificial Sequence; identical to SEQ ID NO: 198743
  derived and/or modified sequence opt5 from neuraminidase__InfluenzaA__AFM71849

SEQ ID NO: 205581 - RNA, 1410 nt, Artificial Sequence; identical to SEQ ID NO: 197119
  derived and/or modified sequence opt5 from neuraminidase__InfluenzaA__AFM71860

SEQ ID NO: 205582 - RNA, 1410 nt, Artificial Sequence; identical to SEQ ID NO: 197351
  derived and/or modified sequence opt5 from neuraminidase__InfluenzaA__AFM71871

SEQ ID NO: 205583 - RNA, 1410 nt, Artificial Sequence; identical to SEQ ID NO: 197351
  derived and/or modified sequence opt5 from neuraminidase__InfluenzaA__AFM71882

SEQ ID NO: 205584 - RNA, 1410 nt, Artificial Sequence
  derived and/or modified sequence opt5 from neuraminidase__InfluenzaA__AFM71893
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauacgccgagaaacgacgauagcuccucuaauagcaacugucgggacccuaauaacgagcgcggaaaucccggcgugaaagggugggccuucgauaacggagacgaugucuggaugggcagaaccauuaauaaggaaucccggagcggguacgagacauuuaaggugaucggaggcuggucuaccccuaacuccaaaagccagguuaauagacaagugauugucgacaacaauaacuggucuggcuauuccgggaucuucagcguggagggaaaguccugcauuaaucgcuguuuuuacgucgaacuuauccggggcagaccccaggagacacgcgugugguggaccucuaacagcauuguuguguucugcgggacguccggaacauauggcaccgggucuuggcccgauggcgcuaauaucaacuuuaugccuaucuga

SEQ ID NO: 205585 - RNA, 1410 nt, Artificial Sequence
  derived and/or modified sequence opt5 from neuraminidase__InfluenzaA__AFM71904
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugucaccauccaugaucggauuccgcaccgcacacugcucaugaacgagcugggggugcccuuucaucugggaaccaagcagguuuguguggcuugguccucuagcuccugccacgacggcaaagccuggcuccacgucugugugacgggcgaugacagaaaugcuacagccagcuucaucuacgaugggcggcugguggacucuauuggauccuggagccaaaacauccuucgcacccaggaaucugagugcgucuguauuaauggcacaugcaccguugugaugaccgauggguccgcgagcggcagagccgacacacggauccuguuuaucaaggagggaaaaauugugcauaucuccccucucucugggagcgcucagcacauugaagagugcuccuguuauccccgcuacccugaugucagaugcaucugucgggacaacuggaagggaagcaaucgccccgugauugacaucaacauggaagauuauucuaucgacuccggcuacguuugcagcggccuggugggggauacgccgagaaacgacgauucuagcuccaauucuaacugucgggacccuaauaacgagcgcggaaaucccggcgucaaagggugggccuucgauaacggagacgauguguggaugggcagaaccauuaauaaggaaagccgguccggguacgagacauuuaagguuaucggaggcuggagcaccccuaacucuaaaucccaggugaauagacaagucauuguggacaacaauaacuggagcggcuauucugggaucuucuccgucgagggaaagagcugcauuaaucgcuguuuuuacguggaacuuauccggggcagaccccaggagacacgcguuugguggaccuccaacucuauuguggucuucugcgggacgagcggaacauauggcaccggguccuggcccgauggcgcuaauaucaacuuuaugccuaucuga

SEQ ID NO: 205586 - RNA, 1410 nt, Artificial Sequence; identical to SEQ ID NO: 197996
  derived and/or modified sequence opt5 from neuraminidase__InfluenzaA__AFM71915

SEQ ID NO: 205587 - RNA, 1410 nt, Artificial Sequence; identical to SEQ ID NO: 197996
  derived and/or modified sequence opt5 from neuraminidase__InfluenzaA__AFM71926

SEQ ID NO: 205588 - RNA, 1410 nt, Artificial Sequence; identical to SEQ ID NO: 197996
  derived and/or modified sequence opt5 from neuraminidase__InfluenzaA__AFM71937

SEQ ID NO: 205589 - RNA, 1410 nt, Artificial Sequence; identical to SEQ ID NO: 205004
  derived and/or modified sequence opt5 from neuraminidase__InfluenzaA__AFM71948

SEQ ID NO: 205590 - RNA, 1410 nt, Artificial Sequence; identical to SEQ ID NO: 205004
  derived and/or modified sequence opt5 from neuraminidase__InfluenzaA__AFM71959

SEQ ID NO: 205591 - RNA, 1410 nt, Artificial Sequence
  derived and/or modified sequence opt5 from neuraminidase__InfluenzaA__AFM71970
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccguaugaacccaucauuaucgagagaaacauuacagaaaucguguaccugaccaauacaaccauugagaaggaaaucugcccuaaacucgucgaguaucggaacuggagcaagccccaguguaaaauuacgggguucgcgccuuuuuccaaggauaauucuauccgccugagcgcuggaggcgacaucugggugaccagagagcccuacguuuccugcgauccugggaaguguuaucaauucgcccuuggacagggcacaacccuggaaaacaaacauucuaaugacacaauucacgaucggaccccgcaucgcacgcuccugaugaacgagcugggggugcccuuucaccucggaacaagacaggucugcaucgccuggagcuccagcucuugucaugacggcaaggcuuggcugcacgugugcguuaccggcuacgauaaaaaugccacagcuuccuucauuuaugacgggcggcuuguggauagcaucggaucuuggucccagaacauucugcgcacccaagaaagcgagugugucugcaucaauggcaccuguacaguggugaugacggacgggucugccuccggacgggcggauaccaagauccucuuuauugaggaaggcaaaaucguccacauuagcccucuguccgggucugcccagcauguugaggaaugcagcugcuacccccgguacccuggagugcgcuguaucugcagagacaacuggaagggcuccaaucggcccguggucgauauuaacgugaaggacuauagcaucgacucuuccuacguuuguagcggccuugugggggauacaccgcgcaaaaacgacagaucuagcuccucuuauugccggaauccuaacaaugagaagggaaaccacggcgucaaagggugggcuuucgaugacggaaaugauguguggaugggccgcaccaucagcgaagacuccagaagcggguacgagacauuuaagguuauuggaggcuggucuacccccaacuccaaacugcagaucaauagacaggugauugucgauagcgccaacagaucuggcuauuccgggaucuucagcguggagggaaaguccuguauuaaucgcugcuuuuacgucgaacucauccggggcagagagcaagaaacgcgcgugugguggacaucuaacagcauuguuguguucugugggaccuccggaaccuauggcacagggucuuggccugacggcgcugauaucaaucugaugcccaucuga

SEQ ID NO: 205592 - RNA, 1410 nt, Artificial Sequence; identical to SEQ ID NO: 205012
  derived and/or modified sequence opt5 from neuraminidase__InfluenzaA__AFM71981

SEQ ID NO: 205593 - RNA, 1410 nt, Artificial Sequence
  derived and/or modified sequence opt5 from neuraminidase__InfluenzaA__AFM71992
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagccaggagauccugcgcacccaagaaucugagugugugugcauuaacgggacauguacgguggucaugaccgacggauccgcuagcggcaaagccgauacaaagauccucuuuaucgaggaagggaaaauuguucauaccuccacacugucuggaagcgcgcagcacguggaggaaugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaggaaggcgggcacggagugaagggcugggccuucgaugacgggaacgauguuuggaugggacgcaccaucaaugagacaagcagacucggcuaugagaccuuuaaagugaucgaaggguggucuaacccuaaguccaaacugcagaugaaucggcaggucauuguggaccgcggaaacagaagcggcuacucuggcaucuucuccgucgaggggaagucuuguauuaaucggugcuuuuauguggaacugaucagaggacgcaaagaggaaaccgagguucucuggacauccaacucuauuguggucuucuguggcaccagcgggacauacggaacgggcuccuggcccgauggggcugaccugaaucuuaugccuaucuga

SEQ ID NO: 205594 - RNA, 1410 nt, Artificial Sequence; identical to SEQ ID NO: 205568
  derived and/or modified sequence opt5 from neuraminidase__InfluenzaA__AFM72013

SEQ ID NO: 205595 - RNA, 1365 nt, Artificial Sequence; identical to SEQ ID NO: 198743
  derived and/or modified sequence opt5 from neuraminidase__InfluenzaA__AFM72024

SEQ ID NO: 205596 - RNA, 1410 nt, Artificial Sequence; identical to SEQ ID NO: 202019
  derived and/or modified sequence opt5 from neuraminidase__InfluenzaA__AFM72035

SEQ ID NO: 205597 - RNA, 1410 nt, Artificial Sequence; identical to SEQ ID NO: 202019
  derived and/or modified sequence opt5 from neuraminidase__InfluenzaA__AFM72046

SEQ ID NO: 205598 - RNA, 1413 nt, Artificial Sequence
  derived and/or modified sequence opt5 from neuraminidase__InfluenzaA__AFM72057
augaaccccaaucagaagaucauuaccaucggcagcauuugcacaacgaucgggauuaucucccugauccuccaaauuggaaacaucauuucuaucugggugagccacuccauucagaccggcucucagaaucauacagggaucuguaaccagagaauuaucaccuacgagaauagcacaugggucaaccaaaccuauguuaauaucaacaauacaaacgugguggccggaaaagacaccacguccgucacccuggcuggcaauucuagccuuugcccuauucgggggugggccaucuacuccaaggauaacagcauucgcaucggaucuaaaggcgacguguucguuauuagagaaccguuuaucuccuguagccaccuggagugccggacauucuuucucacccagggcgcgcugcuuaaugauaagcauucuaacgggacagugaaagaccgcucccccuauagagcucugaugagcuguccuaucggagaagcccccucuccuuacaauucccgguucgagagcgucgccugguccgcuucugccugccacgauggcaugggguggcucaccauuggaaucagcggccccgacgauggggcuguggccguucugaaguauaacggaauuaucacggaaacaauuaaguccuggcgcaaaagaauccugcggacccaggagagcgagugugugugcgucaacggcucuuguuuuacaaucaugaccgacggcccuuccaaugggccggcgagcuaccgcauuuucaagaucgaaaaaggaaagauuaccaaaucuaucgagcucgaugcccccaacagccauuaugaagagugcuccuguuacccugacacaggcacggugaugugcgugugcagagauaauuggcacgggucuaaccggcccugggucagcuuuaaucagaaccuggacuaccaaauuggauauaucuguuccggcguuuucggggauaauccucgccccaaggacggaaagggcagcugcgacccggugaccguggauggcgcugacggggucaaaggauuuucuuacagauauggcaacgggguguggauuggacggacaaaguccaauagcucucgcaaaggcuucgagaugaucugggauccuaacggguggaccgacacagauuccaauuuucuuguuaagcaggacguggucgccaugaccgauuggagcggcuacuccggaucuuucgugcagcaccccgaacugacgggccucgacuguaugagaccuugcuuuuggguugagcugauccgggggagaccccgcgagaaaacaaccauuuggaccagcggauccucuaucagcuucuguggcgugaacuccgauacagcuaauuggagcuggcccgacggggccgaacuuccuuucaccauugauaaguga

SEQ ID NO: 205599 - RNA, 1413 nt, Artificial Sequence; identical to SEQ ID NO: 198083
  derived and/or modified sequence opt5 from neuraminidase__InfluenzaA__AFM72068

SEQ ID NO: 205600 - RNA, 1410 nt, Artificial Sequence
  derived and/or modified sequence opt5 from neuraminidase__InfluenzaA__AFM72090
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccugaacaauaaacauagcaacgauacagugcacgaccggacccccuaucgcacgcuccugaugaaugaacugggggucccuuuucaucucggaacaaaacagguguguauugccugguccuccucuuccugccacgauggcaaggccuggcugcauguuugugugaccggccacgacaagaacgcuacagccagcuucaucuacgaugggagacuugucgacucuauuggauccuggagcaaaaauauccugcggacccaggagucugaaugcguguguauuaacgggaccugcacaguggucaugacggauggcuccgcuagcgagcgcgccgacaccaagauccucuuuaucgaggaaggaaagauuguucacaucagcccccugucuggcagcgcgcaacauguggaggaaugcuccuguuauccuagauaccccggggugcggugcgucugucgcgauaauuggaaaggaagcaacagaccgauuguggacaucaacguuaaggauuacucuauuguguccagcuaugucugcucuggccuugugggcgacacaccucggaaaaaugaccgcagcuccucuagcuacuguagaaaccccaauaacgagaaggggaaucacggaguuaaaggcugggccuucgaugacgggaacgauguguggaugggacggaccaucggcgaggaacugcgccucggguaugagacauuuaaggucaucggaggcugguccaccccuaauagcaaacugcagauuaacagacaggugaucgucgacucuaagaaucgguccggcuacagcgggauuuucucuguggaaggaaaguccugcaucaacagauguuuuuauguugagcugauucgcggccgggaacaggagacgagagugugguggacaagcaauuccaucgucguguucugcgggaccucuggaaccuacggcacagggagcuggcccgauggcgcugacauuaaccucaugcccaucuga

SEQ ID NO: 205601 - RNA, 1410 nt, Artificial Sequence
  derived and/or modified sequence opt5 from neuraminidase__InfluenzaA__AFM72101
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggccaugcccugcgaaccuacaaucauugagagaaacaucaccgaaauuguguaucugacaaauaccacgaucgagaaggaaauuugucccaaacucguggaguaccggaacugguccaagccucagugcaaaaucaccggguucgcgcccuuuucuaaggacaauagcauucgccuguccgcuggaggcgauaucugggucacaagagagccuuaugugucuugugacccggggaagugcuaccaauucgcccuuggacagggcaccacacugaacaaucggcauagcaacgauaccguucacgaccgcacgcccuauagaacacuccugaugaaugaacugggggugccuuuucaucucggaaccaaacaggucuguaucgccugguccuccucuuccugccacgauggcaaggcuuggcugcauguguguguuacaggccacgacaaaaacgccaccgcuagcuucauuuacgaugggcggcuuguggacucuaucggauccuggagcaagaauauucugcgcacccaggagucugaaugcgucuguaucaacggcacaugcacgguggugaugaccgauggguccgccagcgagagagcggacacaaaaauucucuuuaucgaggaaggaaagaucguccacauuagcccccugucuggcagcgcccaacauguugaggaaugcuccuguuauccucgguaccccggggugcgcugcguguguagagauaauuggaagggaagcaaccggccgaucgucgacauuaacgugaaagauuacucuaucguuuccagcuaugugugcucuggccuugucggcgacaccccucgcaagaaugacagaagcuccucuagcuacugucggaaccccaauaacgagaaagggucccacggagugaagggcugggcuuucgaugacgggaaugauguuuggaugggacgcacaauuggcgaggaacugagaagcggguaugagaccuuuaaagugaucggaggcuggucuacgccuaacuccaagcuccagaucaaucggcaggucauuguggacagcggcaacagaucuggguacuccggaaucuucagcgucgaaggcaaauccugcauuaaucgcuguuuuuauguggagcugauccgggggagagaacaggagacacgcguuugguggaccucuaacagcauuguggucuucugcggaaccuccggcacauacgggaccggcucuuggcccgauggagccgacaucaaucugaugcccauuuga

SEQ ID NO: 205602 - RNA, 1410 nt, Artificial Sequence; identical to SEQ ID NO: 197837
  derived and/or modified sequence opt5 from neuraminidase__InfluenzaA__AFM72112

SEQ ID NO: 205603 - RNA, 1410 nt, Artificial Sequence
  derived and/or modified sequence opt5 from neuraminidase__InfluenzaA__AFM72123
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucauuuacgaugggcggcuugucgacucuaucggauccuggagcaagaauauucugcgcacccaggagucugaaugcguguguaucaacggcacaugcacgguggucaugaccgauggguccgcuagcgagagagccgacacaaaaauucucuuuaucgaggaaggaaagaucguucacauuagcccccugucuggcagcgcgcaacauguggaggaaugcuccuguuauccucgguaccccggggugcgcugcgucuguagagauaauuggaagggaagcaaccggccgaucguggacauuaacguuaaagauuacucuaucguguccagcuaugucugcucuggccuugugggcgacaccccucgcaagaaugacagaagcuccucuagcuacugucggaaccccaauaacgagaaagggucccacggaguuaagggcugggccuucgaugacgggaaugauguguggaugggacgcacaauuggcgaggaacugagaagcggguaugagaccuuuaaagucaucggaggcuggucuacgccuaacuccaagcuccagacaaauagacaggugaucgucgacagcggcaaccggucuggguacuccggaauuuucagcguggaaggcaaauccugcaucaaucgcuguuuuuauguugagcugauucgggggagagaacaggagacccgcgugugguggaccucuaacagcaucgucguguucugcggaacauccggcaccuacgggacaggcucuuggcccgauggagcugacauuaaucugaugcccaucuga

SEQ ID NO: 205604 - RNA, 1410 nt, Artificial Sequence; identical to SEQ ID NO: 205159
  derived and/or modified sequence opt5 from neuraminidase__InfluenzaA__AFM72134

SEQ ID NO: 205605 - RNA, 1410 nt, Artificial Sequence
  derived and/or modified sequence opt5 from neuraminidase__InfluenzaA__AFM72145
augaaccccaaucagaagaucauuaccaucggcagcgugucccugacaauugccacgaucugcuuccucaugcaaauugcuauccuggccaucaccgucacacuucacuuuaaacaguacgaguguaacucuccuccgaauaaccagguuaugcugugcgaacccaccauuaucgagagaaauacaaccgaaauuguguaucucacaaacaccacgaucgagaaggaaguguguccuaaacuggcggaguaccggaauuggagcaagccccagugcaaaauuaccggguucgcuccuuuuuccaaggacaacucuauccgccuuagcgccggaggcgauauuugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgcuuggagcuccagcucuugccacgauggcaaggccuggcuucauguguguguuacaggccacgacgagaaugcuaccgccuccuucaucuacgaugggcggcugguggacagcauuggaucuugguccaaaaacauccuccgcacccaggaaagcgagugcgucuguauuaauggcacaugcacgguggugaugaccgaugggucugcguccgagagagccgacacaaagauccuguuuauugaagagggaaaaaucguccacaucagcccucuuuccggcucugcucaacauguugaagagugcagcuguuauccccgguacccuggggugcgcugcguguguagagauaacuggaagggauccaaccggcccauugucgacaucaaugugaaggauuacagcauuguuucuuccuaugugugcagcggccuggucggcgacaccccgcgcaaaaacgacucuagcuccucuagcuacuguagaaauccuaacaaugaaaaggggucccacggagugaaaggcugggccuucgaugacgggaacgauguuuggaugggacggacaaucagcgaggagcuccgcucuggcuaugaaaccuuuaaggugauugggggaugguccaaacccaauagcaagcugcagaucaacagacaggucaucguggaccggggcaauagaucuggcuacuccgggauuuucagcgucgagggaaaauccugcaucaaccgcuguuuuuauguggaacugauucggggcagaaagcaggagacggaaguuugguggacaucuaauagcaucguggucuucugcgggaccuccggaaccuacggcacagggucuuggccugauggcgcugacauuaaccucaugcccaucuga

SEQ ID NO: 205606 - RNA, 1410 nt, Artificial Sequence; identical to SEQ ID NO: 198209
  derived and/or modified sequence opt5 from neuraminidase__InfluenzaA__AFM72156

SEQ ID NO: 205607 - RNA, 1410 nt, Artificial Sequence
  derived and/or modified sequence opt5 from neuraminidase__InfluenzaA__AFM72167
augaaccccaaucagaagaucauuaccaucggcagcauuucccugacaaucgccacgauuugcuuccucaugcaaaucgcuauccuggugaccacagucacccuucacuuuaaacaguacgaguguaacucuccuccgaauaaccagguuaugcugugcgaacccacaauuaucgagagaaauauuaccgaaaucguguaucucacaaacaccacgauugagaaggaaaucuguccugagcuggccgaguaccggaauuggagcaaaccccagugcaagauuaccggguucgcgccuuuuuccaaagacaacucuauccgccuuagcgcuggaggcgauaucugggugacaagagaacccuaugucuccugugacccugggaagugcuaccaauucgcccugggacagggcaccacacucaauaaccggcauucuaaugauaccgugcacgaccgcacgccguauagaacacugcugaugaacgagcucgggguucccuuucaucugggaaccaaacagguguguauugccuggagcuccagcucuugccacgauggcaaggcuuggcuucaugucugugugacaggccacgacgaaaaugccaccgcuuccuucaucuacgaugggcggcugguugacagcauuggaucuugguccaagaacauccuccgcacccaggagagcgagugcguguguauuaauggcacaugcacggucgugaugaccgaugggucugccuccgaaagagcggacacaaaaauccuguuuaucgaggaaggaaagauugugcacaucagcccucuuuccggcucugcccaacaugucgaggaaugcagcuguuauccccgguacccugggguucgcugcguguguagagauaacuggaaaggauccaaccggcccauuguggacaucaaugucaaggauuacagcauugugucuuccuauguuugcagcggccuggugggcgacaccccgcgcaagaacgacucuagcuccucuagcuacuguuggaauccuaacaaugagaaagggggacacggcgucaaggggugggcuuucgaugacggaaacgauguguggaugggcagaacaaucuccgaggaacuccggagcggguaugagaccuuuaaaguuaucggaggcuggucuaagcccaauuccaaacugcagauuaaccgccaggugaucgucgacagaggcaaucggagcggguacucuggaauuuucuccguggaaggcaagagcugcaucaacagauguuuuuaugucgagcugauucgcgggcggaaacaggaaacggaggugugguggacauccaauucuaucguuguguucugcggaaccagcggcaccuacgggacaggcuccuggccugauggagccgacauuaaccucaugcccaucuga

SEQ ID NO: 205608 - RNA, 1410 nt, Artificial Sequence
  derived and/or modified sequence opt5 from neuraminidase__InfluenzaA__AFM72178
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccugagcuggccgaguaccggaauuggagcaaaccccagugcaagaucaccggguucgcgccuuuuuccaaagacaacucuauucgccuuagcgcuggaggcgauaucugggucacaagagaacccuauguguccugugacccugggaagugcuaccaauucgcccugggacagggcaccacacucaauaaccggcauucuaaugauaccguucacgaccgcacgccguauagaacacugcugaugaacgagcucggggugcccuuucaucugggaaccaagcaggucuguaucgccuggagcuccagcucuugccacgauggcaaggcuuggcuucauguguguguuacaggccacgacgaaaaugccaccgcuuccuucauuuacgaugggcggcugguggacagcaucggaucuugguccaaaaacauucuccgcacccaggagagcgagugcgucuguaucaauggcacaugcacgguggugaugaccgaugggucugccuccgaaagagcggacacaaaaauucuguuuaucgaggaaggaaagaucguccacauuagcccucuuuccggcucugcccaacauguugaggaaugcagcuguuauccccgguacccuggggugcgcugcguguguagagauaacuggaaaggauccaaccggcccaucgucgacauuaaugugaaggauuacagcaucguuucuuccuaugugugcagcggccuggucggcgacaccccgcgcaagaacgacucuagcuccucuagcuacuguuggaauccuaacaaugagaaagggggacacggcgugaaggggugggcuuucgaugacggaaacgauguuuggaugggcagaacaauuuccgaggaacuccggagcggguaugagaccuuuaaagugaucggaggcuggucuaagcccaauuccaaacugcagaucaaccgccaggucauuguggacagaggcaaucggagcggguacucuggaaucuucuccgucgaaggcaagagcugcauuaacagauguuuuuauguggagcugauccgcgggcggaaacaggaaacggagguuugguggacauccaauucuauuguggucuucugcggaaccagcggcaccuacgggacaggcuccuggccugauggagccgacaucaaccucaugcccauuuga

SEQ ID NO: 205609 - RNA, 1410 nt, Artificial Sequence
  derived and/or modified sequence opt5 from neuraminidase__InfluenzaA__AFM72189
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuucugggcuccgcccaacauguugaggaaugcucuuguuauccccgguacccuggggugcgcugcguguguagagacaauuggaagggaagcaaccggcccaucgucgauauuaacgugaaagacuacuccaucguuagcucuuaugugugcuccggccucgucggcgacaccccgcgcaagaaugauagcucuagcuccucucacugucugaacccuaauaacgaggaagggggacauggcgugaaagggugggcuuucgacgauggagacgauguuuggaugggcagaacaauuagcgagaagcugcgguccggguacgagaccuuuaaagugaucgaaggauggagcaagcccaauucuaaacuccagaucaaccgccaggucauuguggacagaggcaaucgguccggcuauagcgggaucuucucugucgagggaaaguccugcauuaacagauguuuuuacguggaacugauccgcggccggaagcaggagacggaaguuugguggacaagcaauuccauuguggucuucugcgggaccucuggaaccuauggcacagggagcuggccugauggcgccgacaucaaccuuaugcccauuuga

SEQ ID NO: 205610 - RNA, 1410 nt, Artificial Sequence; identical to SEQ ID NO: 205609
  derived and/or modified sequence opt5 from neuraminidase__InfluenzaA__AFM72200

SEQ ID NO: 205611 - RNA, 1410 nt, Artificial Sequence; identical to SEQ ID NO: 198773
  derived and/or modified sequence opt5 from neuraminidase__InfluenzaA__AFM72211

SEQ ID NO: 205612 - RNA, 1410 nt, Artificial Sequence; identical to SEQ ID NO: 198773
  derived and/or modified sequence opt5 from neuraminidase__InfluenzaA__AFM72222

SEQ ID NO: 205613 - RNA, 1413 nt, Artificial Sequence; identical to SEQ ID NO: 199477
  derived and/or modified sequence opt5 from neuraminidase__InfluenzaA__AFM72233

SEQ ID NO: 205614 - RNA, 1410 nt, Artificial Sequence; identical to SEQ ID NO: 197597
  derived and/or modified sequence opt5 from neuraminidase__InfluenzaA__AFM72249

SEQ ID NO: 205615 - RNA, 1410 nt, Artificial Sequence; identical to SEQ ID NO: 197085
  derived and/or modified sequence opt5 from neuraminidase__InfluenzaA__AFM72260

SEQ ID NO: 205616 - RNA, 1410 nt, Artificial Sequence; identical to SEQ ID NO: 197085
  derived and/or modified sequence opt5 from neuraminidase__InfluenzaA__AFM72271

SEQ ID NO: 205617 - RNA, 1410 nt, Artificial Sequence
  derived and/or modified sequence opt5 from neuraminidase__InfluenzaA__AFM72293
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacuauaccguucacgaccggacgccguaccgcacacugcugaugaaugaacucggggugcccuuucaucugggaaccaagcaggucuguaucgccuggagcuccagcucuugccacgauggcaaagccuggcuucauguguguguuacaggcgacgaugagaacgcuaccgcuuccuucauuuauaaugggagacugguggacagcaucggaucuugguccaagaaaauucuccggacccaggaaagcgagugcgucuguaucaacggcacaugcacgguggugaugaccgaugggucugccuccggaaaggcggacacaaaaauucuguuuaucgaggaaggcaagaucguccacaccagcucccuuucugggagcgcccaacacguugaggaaugcuccuguuacccucgcuaccccggagugagaugcgugugucgggauaacuggaagggcagcaaucgcccuauugucgacaucaacgugaaagauuauucuauuguuuccagcuacgugugcucuggccuggucggggacacacccagaaagaaugacagcuccucuagcucccauugucucgauccgaacaaugaggaaggaggccacggggugaaaggaugggcuuucgacgauggcaacgacguuuggauggggcggaccaucagcgagaagcugcgcucuggauaugagacguuuaaagugauugaaggcugguccaagccuaauagcaaacugcagaucaacagacaggucaucguggaucggggcaaucgcucuggguacuccggaauuuucagcgucgagggcaaguccugcaucaacagauguuuuuauguggaacucauucgggggagaaagcaggagacagaaguucuguggaccucuaauagcaucguggucuucugcggaaccuccggcacauacgggaccggcucuuggcccgacggagccgauauuaaccuuaugccuaucuga

SEQ ID NO: 205618 - RNA, 1410 nt, Artificial Sequence; identical to SEQ ID NO: 198953
  derived and/or modified sequence opt5 from neuraminidase__InfluenzaA__AFM72304

SEQ ID NO: 205619 - RNA, 1410 nt, Artificial Sequence
  derived and/or modified sequence opt5 from neuraminidase__InfluenzaA__AFM72315
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugagaaaggcgggcacggagugaagggcugggccuucgaugacgggaacgauguuuggaugggacggacgaucagcgaaaaacuccgcucuggcuacgagacauuuaaggugaucgaggggugguccaauccuaacagcaaacugcagauuaauagacaggucaucguggaccgggauaaccgcucuggauauuccggcauuuucagcgucgaaggcaaguccuguaucaauagaugcuuuuacguggagcugauucgggggagaaaccaggaaaccgagguucucuggaccucuaauagcaucguggucuucuguggaacauccggcaccuaugggacaggaucuuggcccgacggcgcugauauuaaccugaugccuaucuga

SEQ ID NO: 205620 - RNA, 1410 nt, Artificial Sequence
  derived and/or modified sequence opt5 from neuraminidase__InfluenzaA__AFM72326
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaaguuccagauuaauagacaggucaucguggaccgggauaaccgcucuggauauuccggcauuuuuagcgucgagggcaaauccuguaucaauagaugcuucuacguggaacugauucgggggagaaaccaggagaccgaaguucuguggaccucuaauagcaucguggucuucuguggaacauccggcaccuaugggacaggaucuuggcccgacggcgcugauauuaaccucaugccuaucuga

SEQ ID NO: 205621 - RNA, 1410 nt, Artificial Sequence
  derived and/or modified sequence opt5 from neuraminidase__InfluenzaA__AFM72337
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucaacgagacaagcagacucggcuaugagaccuuuaaggugaucgaaggguggucuaauccuaaauccaagcugcagauuaaccggcaggucaucguggaucgcggaaauagaagcggcuacucuggcauuuucuccgucgaggggaaaagcuguaucaaccggugcuuuuauguggaacugauuagaggacgcaaggaggaaaccgagguucucuggacauccaauucuaucguggucuucuguggcaccagcgggacauacggaacgggcuccuggcccgacggggcugaucugaaccuuaugccuauuuga

SEQ ID NO: 205622 - RNA, 1410 nt, Artificial Sequence
  derived and/or modified sequence opt5 from neuraminidase__InfluenzaA__AFM72348
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucgggauccccuuucaccugggaaccagacagguguguauugccuggagcuccagcucuugccaugacggcaaggcuuggcuucacgucugugugacaggcgaugacaaaaacgccaccgcuuccuucaucuauaaugggcggcugguugauagcauuggaucuugguccaagaaaauccuccgcacccaggagagcgaaugcguguguauuaacggcacaugcacggucgugaugaccgacgggucugccuccggaaaggcggauacaaaaauccuguuuaucgaggagggcaagauugugcacaucagcacccuuuccgggucugcccaacaugucgaagagugcagcuguuacccuagauaucccggaguucggugcgugugucgcgacaacuggaagggcuccaauagaccuauuguggauaucaacgucaaagacuacagcauugugucuuccuacguuugcagcggccuggugggggacacaccccggaagaaugauucuagcuccucuagccacugucucgacccgaacaaugaagagggaggccauggggucaaaggaugggcuuucgaugacggcaacgauguguggauggggcgcaccaucuccgaaaagcugagaagcggauaugagacguuuaaaguuaucgagggcuggucuaagccuaauuccaaacugcagauuaaccgccaggugaucgucgaacggggcaauagaagcggguacucuggaauuuucuccguggagggcaagagcugcaucaaccgguguuuuuaugucgaacucauuagagggcgcaaggaggaaacagaggugugguggaccuccaauucuaucguuguguucugcggaaccagcggcacauacgggaccggcuccuggcccgacggagccgauauuaaccugaugccuaucuga

SEQ ID NO: 205623 - RNA, 1410 nt, Artificial Sequence
  derived and/or modified sequence opt5 from neuraminidase__InfluenzaA__AFM72359
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagaccaaaguucucuggaccucuaauagcaucguggucuucuguggcacauccgggaccuauggaacaggcucuuggcccgacggggcugauauuaaccugaugccuaucuga

SEQ ID NO: 205624 - RNA, 1410 nt, Artificial Sequence; identical to SEQ ID NO: 205623
  derived and/or modified sequence opt5 from neuraminidase__InfluenzaA__AFM72370

SEQ ID NO: 205625 - RNA, 1410 nt, Artificial Sequence; identical to SEQ ID NO: 202542
  derived and/or modified sequence opt5 from neuraminidase__InfluenzaA__AFM72381

SEQ ID NO: 205626 - RNA, 1410 nt, Artificial Sequence; identical to SEQ ID NO: 202542
  derived and/or modified sequence opt5 from neuraminidase__InfluenzaA__AFM72392

SEQ ID NO: 205627 - RNA, 1410 nt, Artificial Sequence; identical to SEQ ID NO: 199426
  derived and/or modified sequence opt5 from neuraminidase__InfluenzaA__AFM72403

SEQ ID NO: 205628 - RNA, 1410 nt, Artificial Sequence; identical to SEQ ID NO: 199426
  derived and/or modified sequence opt5 from neuraminidase__InfluenzaA__AFM72414

SEQ ID NO: 205629 - RNA, 1410 nt, Artificial Sequence; identical to SEQ ID NO: 199090
  derived and/or modified sequence opt5 from neuraminidase__InfluenzaA__AFM72425

SEQ ID NO: 205630 - RNA, 1410 nt, Artificial Sequence; identical to SEQ ID NO: 199090
  derived and/or modified sequence opt5 from neuraminidase__InfluenzaA__AFM72436

SEQ ID NO: 205631 - RNA, 1410 nt, Artificial Sequence; identical to SEQ ID NO: 199090
  derived and/or modified sequence opt5 from neuraminidase__InfluenzaA__AFM72447

SEQ ID NO: 205632 - RNA, 1410 nt, Artificial Sequence; identical to SEQ ID NO: 199090
  derived and/or modified sequence opt5 from neuraminidase__InfluenzaA__AFM72458

SEQ ID NO: 205633 - RNA, 1410 nt, Artificial Sequence; identical to SEQ ID NO: 199090
  derived and/or modified sequence opt5 from neuraminidase__InfluenzaA__AFM72469

SEQ ID NO: 205634 - RNA, 1410 nt, Artificial Sequence
  derived and/or modified sequence opt5 from neuraminidase__InfluenzaA__AFM72491
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugaugugugaacccacaauuaucgagagaaauauuaccgaaaucguguaucuuacaaacaccacgauugagaaggaaaucugcccuaaacuggcugaguaccggaauugguccaagccccagugugacauuaccggguucgccccuuuuucuaaagauaacagcauccgccucuccgcgggaggcgacaucugggugacaagagagcccuaugucucuugcgauccugacaaguguuaccaauucgcucuggggcagggaaccacacuuaauaacgugcauagcaaugauaccguucgggaccgcacgccguauagaacacugcucaugaacgaacugggcgugcccuuucaccuggggaccaagcaggucugcauugccugguccucuagcuccugucaugauggaaaagccuggcuccacgugugcaucacaggcgacgauaagaaugcuaccgccagcuucauuuacaacggccggcugguugacucuaucguguccuggagcaaagagauucuucgcacccaggaaucugagugugucugcaucaaugggacauguacgguggugaugaccgauggauccgcuagcggcaaggccgacacaaaaauccuguuuauugaggaagggaagaucguccauaccuccacacucucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuggugggcgauacgccccggaagaacgacagcuccucuagcucccauugccuugauccgaauaacgaggaaggcgggcacggagucaaaggcugggccuucgacgaugggaaugacguguggaugggacgcaccaucagcgagaagucuagacugggcuaugagacauuuaaaguuauugaagggugguccaacccuaauagcaagcuccagaucaaccgccaggugauugucgaucggggaaauagaucuggcuacuccggcaucuucagcguggaggggaaauccuguauuaaccggugcuuuuaugucgaacugaucagaggacgcaaggaggaaaccgaggugcuguggaccucuaauagcauuguuguguucuguggcacauccgggaccuacggaacaggcucuuggcccgacggggcugauaucaaccucaugccuaucuga

SEQ ID NO: 205635 - RNA, 1410 nt, Artificial Sequence; identical to SEQ ID NO: 205634
  derived and/or modified sequence opt5 from neuraminidase__InfluenzaA__AFM72502

SEQ ID NO: 205636 - RNA, 1413 nt, Artificial Sequence; identical to SEQ ID NO: 199656
  derived and/or modified sequence opt5 from neuraminidase__InfluenzaA__AFM72513

SEQ ID NO: 205637 - RNA, 1413 nt, Artificial Sequence; identical to SEQ ID NO: 199656
  derived and/or modified sequence opt5 from neuraminidase__InfluenzaA__AFM72524

SEQ ID NO: 205638 - RNA, 1413 nt, Artificial Sequence; identical to SEQ ID NO: 199656
  derived and/or modified sequence opt5 from neuraminidase__InfluenzaA__AFM72535

SEQ ID NO: 205639 - RNA, 1413 nt, Artificial Sequence; identical to SEQ ID NO: 199656
  derived and/or modified sequence opt5 from neuraminidase__InfluenzaA__AFM72546

SEQ ID NO: 205640 - RNA, 1413 nt, Artificial Sequence; identical to SEQ ID NO: 199656
  derived and/or modified sequence opt5 from neuraminidase__InfluenzaA__AFM72557

SEQ ID NO: 205641 - RNA, 1410 nt, Artificial Sequence
  derived and/or modified sequence opt5 from neuraminidase__InfluenzaA__AFM72579
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucacgaccggacaccguaucgcacccuccugaugaacgaacugggcgugcccuuucaucucgggacaaagcaggucugcaucgccugguccucuagcuccugucacgauggaaaagccuggcugcaugugugcauuaccggcgacgauaagaaugcuaccgccagcuucaucuacaacggcagacuuguugacucuauuguguccuggagcaaagagauccugcggacacaggaaucugagugugucugcauuaaugggacguguaccguggugaugacagauggauccgcuagcggcaaggccgacaccaaaauccucuuuaucgaggaagggaagauuguccacacauccauccugucuggaagcgcgcaacacguugaggaaugcuccugcuauccucgcuaccccggcgugagaugugugugccgggauaacuggaaggggagcaaccgcccuauugucgacaucaauauuaaagaccauucuaucguguccagcuacguuuguucuggacuugugggcgauacccccagaaagaacgacagcuccucuagcucccacugccuggauccgaauaacgaggaaggcgggcauggagucaaaggcugggccuucgacgaugggaaugacguguggaugggacggacgaucagcgagaagucucgccucggcuaugagacauuuaaaguuauugaagggugguccaacccuaagagcaaacugcagaucaauagacaggugauugucgaucggggaaaccgcucuggcuacuccggcaucuucagcguggaggggaaguccuguauuaauagaugcuuuuaugucgaacugauccggggaagaaaggaggaaaccgaggugcucuggaccucuaacagcauuguuguguucuguggcacauccgggaccuacggaacaggcucuuggcccgacggggcugauaucaaucugaugccuaucuga

SEQ ID NO: 205642 - RNA, 1413 nt, Artificial Sequence
  derived and/or modified sequence opt5 from neuraminidase__InfluenzaA__AFM72802
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaugugcaaccagagaaucauuaccuacgaaaauuccacaugggugaaccacaccuaugucaauaucaacaauacaaacguuguggccggaaaagacaagaccccugugacacuggcgggcaauucuagccuuuguuccaucagcgggugggcuauucauaccaaagauaacucuauccggauuggauccaagggcgacgucuucgugauccgcgagccguuuauuagcugcucucaccuggaguguaaaacguucuuucucacccaaggcgcccugcuuaaugauaagcauuccaacgggacaguuaaggacagaagccccuaccgggcccugaugucuugcccucucggagaagcucccuccccuuauaauagcaaauucgaguccguggccuggucugcuagcgccugucacgauggcaucggguggcugaccaucggaauuuccggccccgacaacggggcggucgccgugcugaaguacaacggaaucauuacaggcaccaucaaaagcuggaagaaacagauucuccgcacgcaggaaucugagugcguuuguaugaauggcuccugcuuuacaaucaugaccgaugggccuagcaacggagcugccucuuauaagaucuucaagauugagaaaggcaaggugaucaaaagcauggaacugaaugcuccgaacuuucacuacgaggaauguuccugcuaucccgacacagggaccgucaugugugugugcagagauaauuggcauggaucuaaccggccuugggugagcuucaaucagaaccuugacuaccaaauuggcuacaucugcuccggggucuuuggagauaauccccgcccugaggacggcgagggcagcuguaaccccguuaccguggauggggccaauggagugaagggcuucucuuauaaauacgggaacggagucuggauuggcagaacaaaguccaaucggauccgcaaaggguuugaaaugauuugggacccgaacggcuggacgaauaccgacagcgauuucucugugaagcaggacaucguugcgaucacagauugguccggauauagcggcuccuuugugcagcacccugagcugaccgggcucgacugcauuagacccuguuucugggucgaacuggugcggggacuuccucgcgagaacacaaccaucuggacgucuggcagcuccauuucuuucugcgggguuaacagcgauaucgccaauugguccuggcccgacggagcugaacugcccuuuacaauugauaaguga

SEQ ID NO: 205643 - RNA, 1413 nt, Artificial Sequence; identical to SEQ ID NO: 205642
  derived and/or modified sequence opt5 from neuraminidase__InfluenzaA__AFM72813

SEQ ID NO: 205644 - RNA, 1413 nt, Artificial Sequence; identical to SEQ ID NO: 205642
  derived and/or modified sequence opt5 from neuraminidase__InfluenzaA__AFM72824

SEQ ID NO: 205645 - RNA, 1410 nt, Artificial Sequence; identical to SEQ ID NO: 199752
  derived and/or modified sequence opt5 from neuraminidase__InfluenzaA__AFM72835

SEQ ID NO: 205646 - RNA, 1410 nt, Artificial Sequence; identical to SEQ ID NO: 199752
  derived and/or modified sequence opt5 from neuraminidase__InfluenzaA__AFM72845

SEQ ID NO: 205647 - RNA, 1410 nt, Artificial Sequence; identical to SEQ ID NO: 199752
  derived and/or modified sequence opt5 from neuraminidase__InfluenzaA__AFM72855

SEQ ID NO: 205648 - RNA, 1410 nt, Artificial Sequence; identical to SEQ ID NO: 199752
  derived and/or modified sequence opt5 from neuraminidase__InfluenzaA__AFM72865

SEQ ID NO: 205649 - RNA, 1410 nt, Artificial Sequence
  derived and/or modified sequence opt5 from neuraminidase__InfluenzaA__AFM72875
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagucugauuccucuagcuccagccauugccuggacccgaauaacgaggaaggcgggcacggagugaaaggcugggccuucgaugacgggaaugauguuuggaugggacgcaccaucucugagaaguccagacucggcuaugagacauuuaaagugaucgaaggguggagcaacccuaagucuaaacugcagauuaaucggcaggucaucguggaccgcggaaacagauccggcuacagcggcauuuucuccgucgaggggaagucuuguaucaaucggugcuuuuauguggaacugauuagaggacgcaaggaggaaaccgagguucucuggaccagcaacuccaucguggucuucuguggcacaucugggaccuacggaacaggcagcuggcccgauggggcugacauuaaucugaugccuguguga

SEQ ID NO: 205650 - RNA, 1410 nt, Artificial Sequence; identical to SEQ ID NO: 199623
  derived and/or modified sequence opt5 from neuraminidase__InfluenzaA__AFM72886

SEQ ID NO: 205651 - RNA, 1410 nt, Artificial Sequence; identical to SEQ ID NO: 199623
  derived and/or modified sequence opt5 from neuraminidase__InfluenzaA__AFM72897

SEQ ID NO: 205652 - RNA, 1410 nt, Artificial Sequence
  derived and/or modified sequence opt5 from neuraminidase__InfluenzaA__AFM72908
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaccaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcacaauuagcgagaagucuagacucggcuaugagaccuuuaaagugaucgaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaaccgagguucucuggacaucuaauagcauuguggucuucuguggcaccuccgggacauacggaacgggcucuuggcccgauggggcugacaucaaccugaugccuguguga

SEQ ID NO: 205653 - RNA, 1410 nt, Artificial Sequence
  derived and/or modified sequence opt5 from neuraminidase__InfluenzaA__AFM72919
augaaccccaaucagaagaucauuaccaucggcagcgugucccugacaauuucuacgaucugcuucuuuaugcaaauugccauccucaucaccacagucacccugcacuucaaacagcaugaguuuaacagcccuccgaauaaccagguuaugcuuugugaacccacaauuaucgagagaaauauuaccgaaaucguguaccugacaaacaccacgauugagaaggaaaucugcccuaaacucgcugaguaucggaauugguccaagccccagugugacauuaccggguucgccccuuuuucuaaagauaacagcauccgccuguccgcgggaggcgacaucugggugacaagagagcccuacgucucuugcgauccugacaaguguuaucaauucgcucuugggcagggaaccacacugaauaacgugcacagcaauaacaccguucgggaucgcacgccguacagaacacuccugaugaaugaacugggcgugcccuuucaucucgggaccaagcaggucugcauugccugguccucuagcuccugucacgacggaaaagccuggcugcaugugugcaucacaggcgaugacaagaacgcuaccgccagcuucauuuauaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuacccuagauaucccggcgugcggugugucugccgcgacaacuggaaggggagcaauagaccuaucguggauauuaacaccaaagaccauucuaucguuuccagcuacguguguucuggacuugucggcgacacgccccggaagaaugauagcuccucuagcucccacugccuggacccgaacaaugaggaaggcgggcauggagugaaaggcugggccuucgaugacgggaacgauguuuggaugggacgcacaauuagcgagaagucuagacucggcuacgagaccuuuaaagugaucgaagggugguccaauccuaagagcaaacugcagaucaaccggcaggucauuguggaccgcggaaauagaucuggcuauuccggcaucuucagcgucgaggggaaguccuguauuaaccggugcuuuuacguggaacugaucagaggacgcaaggaggaaaccgagguucucuggacaucuaauagcauuguggucuucuguggcaccuccgggacauauggaacgggcucuuggcccgauggggcugacaucaaccugaugccuguguga

SEQ ID NO: 205654 - RNA, 1410 nt, Artificial Sequence; identical to SEQ ID NO: 200929
  derived and/or modified sequence opt5 from neuraminidase__InfluenzaA__AFM72930

SEQ ID NO: 205655 - RNA, 1410 nt, Artificial Sequence; identical to SEQ ID NO: 200929
  derived and/or modified sequence opt5 from neuraminidase__InfluenzaA__AFM72941

SEQ ID NO: 205656 - RNA, 1410 nt, Artificial Sequence; identical to SEQ ID NO: 200929
  derived and/or modified sequence opt5 from neuraminidase__InfluenzaA__AFM72952

SEQ ID NO: 205657 - RNA, 1410 nt, Artificial Sequence; identical to SEQ ID NO: 200929
  derived and/or modified sequence opt5 from neuraminidase__InfluenzaA__AFM72963

SEQ ID NO: 205658 - RNA, 1410 nt, Artificial Sequence; identical to SEQ ID NO: 200929
  derived and/or modified sequence opt5 from neuraminidase__InfluenzaA__AFM72974

SEQ ID NO: 205659 - RNA, 1410 nt, Artificial Sequence; identical to SEQ ID NO: 202542
  derived and/or modified sequence opt5 from neuraminidase__InfluenzaA__AFM72985

SEQ ID NO: 205660 - RNA, 1410 nt, Artificial Sequence; identical to SEQ ID NO: 202542
  derived and/or modified sequence opt5 from neuraminidase__InfluenzaA__AFM72996

SEQ ID NO: 205661 - RNA, 1410 nt, Artificial Sequence; identical to SEQ ID NO: 202542
  derived and/or modified sequence opt5 from neuraminidase__InfluenzaA__AFM73007

SEQ ID NO: 205662 - RNA, 1410 nt, Artificial Sequence
  derived and/or modified sequence opt5 from neuraminidase__InfluenzaA__AFM73018
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggaucuggauuggaagaacaaaauccaucucuagccggaagggcuucgagaugaucugggauccuaacggguggaccggaaccgacaauaacuuuuccauuaaacaagacaucgugggcauuaaugaauggucuggguacagcggcuccuucguucagcaucccgagcuuacaggacuggauuguauccgcccuugcuucuggguggaacucauuagaggccggcccaaggagaacacgaucuggaccagcgggucuuccaucagcuuuuguggagucaauucugacacagugggcugguccuggcccgauggggcugagcugccuuucaccauugacaaauga

SEQ ID NO: 205663 - RNA, 1410 nt, Artificial Sequence; identical to SEQ ID NO: 205662
  derived and/or modified sequence opt5 from neuraminidase__InfluenzaA__AFM73028

SEQ ID NO: 205664 - RNA, 1410 nt, Artificial Sequence; identical to SEQ ID NO: 205662
  derived and/or modified sequence opt5 from neuraminidase__InfluenzaA__AFM73038

SEQ ID NO: 205665 - RNA, 1410 nt, Artificial Sequence; identical to SEQ ID NO: 201497
  derived and/or modified sequence opt5 from neuraminidase__InfluenzaA__AFM73048

SEQ ID NO: 205666 - RNA, 1410 nt, Artificial Sequence
  derived and/or modified sequence opt5 from neuraminidase__InfluenzaA__AFM73058
augaaccccaaucagaagaucauuaccaucggcagcuucugcaugacaauugggcuggccaaccucauccugcaaauuggaaauaucaucuccauuuggaucucucacagcauucagcuuggcaaccagaaucagaucgagacguguaaccaauccgugauuaccuacgaaaauaacacaugggucaaucagaccuauguuaacaucucuaauacaaacuuugcugccgggcagagcgugguguccgucaaacuggcgggaaauucuagccucugcccuguguccggcugggcuauuuacagcaaggacaacucuguuagaaucggguccaaaggagauguguucgucauccgggagccguuuauuagcuguucuccccuggaaugccgcaccuucuuucuuacacagggcgcccugcucaaugacaagcauuccaacggcaccaucaaagauagaagcccuuaucggacgcugaugucuugucccauuggggaggugccuucccccuacaacagccgcuucgaauccguugccuggucugcuagcgccugccacgacggaaucaauuggcugaccauuggcaucuccgggccugauaacggagcuguggccguccucaaguauaauggcaucauuacagacaccaucaagagcuggagaaacaauauucugcggacacaagagucugagugugcgugcgugaacggguccuguuuuaccgugaugacggauggaccgagcgacggccaggccucuuacaaaaucuuccgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuuuaaucagaaccuugaauaucgcauuggauacaucuguucuggcauuuucggggauaauccuagacccaacgacaaaaccggauccugcggcccggucagcucuaauggggccaacggagugaagggcuuuuccuucaaguauggcaacgggguuuggaucggacggacaaaaagcauuuccucucgcaauggcuuugagaugaucugggauccuaacggguggaccggaaccgacaagaauuucagcauuaaacaggacaucgugggcaucaacgaaugguccggguacucuggcagcuucguccaacaucccgagcugacaggacucgauuguauuagaccuugcuuuuggguggaacugauccggggccgccccaaggagaauacgauuuggaccuccgggagcucuaucuccuucuguggaguuaacagcgacacagugggcuggucuuggcccgauggggcugagcuuccuuuuaccauugacaaauga

SEQ ID NO: 205667 - RNA, 1410 nt, Artificial Sequence; identical to SEQ ID NO: 201497
  derived and/or modified sequence opt5 from neuraminidase__InfluenzaA__AFM73068

SEQ ID NO: 205668 - RNA, 1413 nt, Artificial Sequence; identical to SEQ ID NO: 197975
  derived and/or modified sequence opt5 from neuraminidase__InfluenzaA__AFM73480

SEQ ID NO: 205669 - RNA, 1350 nt, Artificial Sequence
  derived and/or modified sequence opt5 from neuraminidase__InfluenzaA__AFM78569
augaaccccaaucagaagaucauuaccaucggcagcauuugcauggugaucgggauugucucccugaugcuccaaaucggaaacaugaucucuauuuggguuauccacagcauucagacaggcaaucagcaucaggccgaguccaucucuaacacgaauccucugaccgaaaaagcuguggccagcgugacacuugcggggaacuccucucuguguccgauuagaggaugggcuguccacagcaaggacaauaacauccggauuggcuccaaaggggauguguucguuauccgcgagcccuuuaucagcugcucucaucucgaauguagaaccuucuuucugacacaaggagcccuucugaaugacaagcacuccaacggcaccgugaaagaucggagcccucaucgcacacucaugucuugccccgucggcgaggccccuucccccuacaauagcagauucgaaucuguggcuugguccgccagcgcuugucacgacgggaccuccuggcugacgauuggaaucucuggcccugauaacgaggccguugcggugcugaaguauaaugggauuaucaccgacacaauuaagagcuggcggaacgauauccuccgcacccaggaguccgaaugcgccugugucaauggaagcugcuuuacagugaugaccgacggcccgucuaacgggcaggcuuccuacaaaaucuucaagauggagaaaggaaagguggucaaaagcguugaacuggaugcccccaacuaucacuacgaggaguguucuugcuauccugacgcuggcgaaauuacgugugugugcagagauaauuggcauggcagcaaccggcccuggguguccuuuaaucagaaccuugaguaccaaaucggguauauuugcucuggagucuucggcgacaauccucgccccaacgaugggacaggaagcuguggcccgauguccccuaauggggccuacggagugaagggcuuuagcuucaaguacggcaacgggguuuggaucggaagaaccaaaucuacaaauucccggagcggcuuugaaaugauuugggaccccaacggguggaccggaaccgacucuuccuucagcgugaagcaggauaucgucgcgaucacagacugguccggcuauucugggagcuuugugcagcacccugagcugacgggccucgauugcauucgccccuguuucuggguugaacugaucagaggacggcccaaagaguccaccauuuggacaucuggcagcuccaucagcuucugcggggucaauucugacaccguguccuggagcuggccugauggagccgagcuuccguuuacaauugacaaguga

SEQ ID NO: 205670 - RNA, 1410 nt, Artificial Sequence
  derived and/or modified sequence opt5 from neuraminidase__InfluenzaA__AFM85180
augaaccccaaucagaagaucauuaccaucggcagcgugucccugacaauugccacgaucugcuuccucacccaaauugcuauccuggucacaaccguuacacuucacuuuaaacaguacgaguguaacucuagcccuaauaaccaggugaugcugugcgaaccgaccaucauugagagaaauaucacagaaauuguguaucucaccaacacgaccaucgagaaggaaauuugucccaaacuggccgaguaccggaauugguccaagccucagugcaacaucacaggguucgcgcccuuuucuaaagacaauagcauucgccuuuccgcuggaggcgauaucugggucaccagagagccuuaugugucuugugggcccgacaagugcuaccaauucgcccugggacagggcacaacccucaacaaugggcauagcaacgauacgguucacgaccggacaccuuaucgcacccugcugaugaaugaacucggagugccguuucaucugggcacaaagcaggucuguaucgccugguccucuagcuccugccacgauggcaaggcuuggcuucauguguguguuaccggggacgauaaaaacgccaccgcuagcuucauuuacaauggaagacugguggacucuaucggcuccuggagcaaaaagauucuccggacacaggagucugaaugcgucuguaucaacgggacgugcaccguggugaugacagauggauccgccagcggcaaagcggacaccaagauucuguuuaucgaggaggggaagaucguccacacaucccuucugucuggaagcgcccaacacguugaagagugcuccuguuauccccgcuacccuggcgugagaugcgugugucgggauaacuggaaaggcagcaaucgccccauugucgacaucaacgugaaggauuacucuauuguuuccagcuaugugugcucugggcucgucggagacaccccucggaaaaaugacagcuccucuagcucccauugucuggaucccaacaaugaagagggcgggcacggagugaagggcugggcuuucgacgaugggaacgacguuuggaugggaagaacgaucagcgaaaaacugcgcucuggcuacgagacauuuaaggugauugagggcugguccaaaccgaauagcaagcuccagaucaacagacaggucaucguggaucgggggaaucgcucuggauauuccggcauuuucagcgucgaagggaaguccugcaucaacagauguuuuuacguggagcugauucggggaagaaaucaggaaaccgagguucuuuggaccucuaacagcaucguggucuucugcggcacauccgggaccuauggcacaggaucuuggccugacggcgccgauauuaaucugaugcccaucuga

SEQ ID NO: 205671 - RNA, 1410 nt, Artificial Sequence; identical to SEQ ID NO: 197127
  derived and/or modified sequence opt5 from neuraminidase__InfluenzaA__AFN11830

SEQ ID NO: 205672 - RNA, 1410 nt, Artificial Sequence
  derived and/or modified sequence opt5 from neuraminidase__InfluenzaA__AFN11831
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuugguccaagaacauucugcgcacccaggagagcgaaugcgucuguaucaauggaaccugcacaguggugaugacggaugggucugccuccggcagagcggacaccaaaauccucuuuauugaggagggcaagaucguccacauuagcccucuguccgggucugcccaacauguugaagagugcagcuguuauccccgguacccuggagugcgcugcguguguagagauaacuggaagggcuccaaucggcccgucguggacaucaacguuaaagacuacagcauugugucuuccuaugucugcagcggccuugugggggauacaccgcgcaacaaugacagaucuagcuccucuuacugucggaacccuaauaacgaaaagggaaaucacggcguuaaagggugggcuuucgaugacggaaacgauguguggaugggccgcaccaucagcgaggaauccagaagcggguaugagacauuuaaggucaucggaggcuggucuacccccaauuccaaacugcagauuaacagacaggugaucgucgacagcgauaaucggucuggcuacuccgggauuuucagcguggagggaaaguccugcaucaaccgcuguuuuuauguugaacucauucggggcagagagcaggaaacgcgcgugugguggacaucuaauagcaucgucguguucugcgggaccuccggaaccuacggcacagggucuuggccugacggcgccgauauuaaccugaugcccaucuga

SEQ ID NO: 205673 - RNA, 1410 nt, Artificial Sequence; identical to SEQ ID NO: 197600
  derived and/or modified sequence opt5 from neuraminidase__InfluenzaA__AFN11833

SEQ ID NO: 205674 - RNA, 1410 nt, Artificial Sequence; identical to SEQ ID NO: 199535
  derived and/or modified sequence opt5 from neuraminidase__InfluenzaA__AFN11835

SEQ ID NO: 205675 - RNA, 1410 nt, Artificial Sequence
  derived and/or modified sequence opt5 from neuraminidase__InfluenzaA__AFN11836
augaaccccaaucagaagaucauuaccaucggcagcgugucccugacaauugccacgaugugcuuccucaugcaaaucgcuauucuggucaccacaguuacccuucacuuuaaacaguacgaguguucuagcccuccgaacaaucaggugaugcccugcgaaccuacaaucaucgagagaaacauuaccgaaaucguguaucugacaaauaccacgauugagaaggaaaucugucccaaacucgucgaguaccggaacugguccaagccucagugcaaaauuaccggguucgcccccuuuucuaaggacaauagcauccgccuguccgcgggaggcgauauuugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucaucuacgaugggcggcuugucgacucuauuggauccuggagcaagaauauccugcgcacccaggagucugaaugcguguguauuaacggcacaugcacgguggucaugaccgauggguccgcuagcgagagagccgacacaaaaauccucuuuauugaggaaggaaagaucauccacauuagcccccugucuggcagcgcgcaacauguugaggaaugcuccuguuauccucgguaccccggggugcgcugcguguguagagauaauuggaagggaagcaaccggccgaucgucgacauuaacgugaaagauuacucuaucguuuccagcuaugugugcucuggccuugucggcgacaccccucgcaagaaugacagaagcuccucuagcuacugucggaaccccaauaacgagaaagggucccacggagugaagggcugggccuucgaugacgggaaugauguuuggaugggacgcacaauuggcgaggaacugagaagcggguaugagaccuuuaaagugaucggaggcuggucuacgccuaacuccaagcuccagaucaaucggcaggucauuguggacagcggcaacagaucuggguacuccggaaucuucagcgucgaaggcaaauccugcauuaaucgcuguuuuuauguggagcugauccgggggagagaacaggagacacgcguuugguggaccucuaacagcauuguggucuucugcggaaccuccggcacauacgggaccggcucuuggcccgauggagcugacaucaaucugaugcccauuuga

SEQ ID NO: 205676 - RNA, 1410 nt, Artificial Sequence
  derived and/or modified sequence opt5 from neuraminidase__InfluenzaA__AFN11839
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugccagccuacaaucauugaaagaaacaucaccgagauuguguaucugacaaauaccacgaucgaaaaggagauuugucccaaacucgucgaauaccggaacugguccaagccucaaugcaaaaucaccggguucgcccccuuuucuaaggacaauagcauucgccuguccgcgggaggcgauaucugggugacaagagagccuuauguuucuugugacccggggaagugcuaccaguucgcucuuggacagggcaccacacugaacaaucggcauagcaacgauaccgugcacgaccgcacgcccuauagaacacuccugaugaaugagcugggggucccuuuucaucucggaaccaaacagguguguaucgccugguccuccucuuccugccacgauggcaaggccuggcugcauguuugugugacaggccacgacgaaaacgcuaccgccagcuucauuuacgaugggcggcuugucgacucuaucggauccuggagcaaaaauauucugcgcacccaagagucugaaugcguguguaucaacggcacaugcacgguggucaugaccgauggguccgcuagcgagagagccgacacaaagauucucuuuaucgaggaaggaaaaaucguucacauuagcccccugucuggcagcgcgcagcauguggaggaaugcuccuguuauccucgguaccccggggugcgcugcgucuguagagauaauuggaagggaagcaaccggccgaucguggacauuaacaugaaggauuacucuaucguuuccagcuaugugugcucuggccuugucggcgacaccccucgcaaaaaugacagcuccucuagcuccuacuguagaaaccccaauaacgagaaggggagccacggagugaaaggcugggccuucgaugacgggaaugauguuuggaugggacggacaauuucugaggaacugcgcuccggcuaugagaccuuuaaggugaucgggggauggagcacgccuaacucuaaacuccagaucaauagacaggucauuguggacuccggcaaccggagcggcuacuccgggaucuucucugucgaaggaaagagcugcauuaauagauguuuuuauguggagcugauccgcggccggaaacaagaaacaaagguuugguggaccuccaacucuauuguggucuucugcgggaccagcggaacauacggcaccggguccuggcccgauggcgcugacaucaaucugaugcccauuuga

SEQ ID NO: 205677 - RNA, 1410 nt, Artificial Sequence
  derived and/or modified sequence opt5 from neuraminidase__InfluenzaA__AFN11840
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguagaaauccuaacaaugaaaaggggucccacggagugaaaggcugggcuuucgaugacgggaacgauguuuggaugggacggacaauuggcgaggagcuccgcagcggguaugaaaccuuuaaggugaucggaggcuggucuacgcccaauuccaaacugcagaucaacagacaggucauuguggaccggggcaauagaagcggguacucuggaaucuucuccgucgagggcaagagcugcauuaaccgcuguuuuuauguggaacugguucgggggagaaaacaggagacagaagugugguggaccuccaauucuaucgucguguucugcggaaccagcggcacauacgggaccggcuccuggccugauggagccgacauuaaccucaugcccaucuga

SEQ ID NO: 205678 - RNA, 1410 nt, Artificial Sequence; identical to SEQ ID NO: 198953
  derived and/or modified sequence opt5 from neuraminidase__InfluenzaA__AFN11841

SEQ ID NO: 205679 - RNA, 1410 nt, Artificial Sequence; identical to SEQ ID NO: 205041
  derived and/or modified sequence opt5 from neuraminidase__InfluenzaA__AFN11842

SEQ ID NO: 205680 - RNA, 1410 nt, Artificial Sequence
  derived and/or modified sequence opt5 from neuraminidase__InfluenzaA__AFN11844
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucgggaucgcacgccguauagaacacuccugaugaaugaacugggcgugcccuuucaccucgggaccaagcaggucugcauugccugguccucuagcuccugucaugacggaaaagccuggcugcacgugugcguuacaggcgaugacaagaacgcuaccgccagcuucaucuacaauggccggcuuguggauucuauugucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagacuacucuauuguuuccagcuauguguguucuggacuugucggcgacacgccccggaagaaugauagcuccucuagcucccacugccuggacccgaacaaugaggaaggcgggcauggagugaaaggcugggccuucgaugacgggaacgauguuuggaugggacgcaccaucagcgagaagcucagaucuggcuacgagacauuuaaagugaucgaagggugguccaauccuaacagcaagcugcagauuaaucggcaggucaucguggaccgcggaaacagaucuggcuauuccggcauuuucagcgucgaggggaaauccuguaucaaucggugcuuuuacguggaacugauuagaggacgcaaggaggaaaccgagguucucuggaccucuaacagcaucguggucuucuguggcacauccgggaccuauggaacaggcucuuggcccgauggggcugacauuggccugaugccuauguga

SEQ ID NO: 205681 - RNA, 1410 nt, Artificial Sequence; identical to SEQ ID NO: 205600
  derived and/or modified sequence opt5 from neuraminidase__InfluenzaA__AFN11845

SEQ ID NO: 205682 - RNA, 1410 nt, Artificial Sequence; identical to SEQ ID NO: 205128
  derived and/or modified sequence opt5 from neuraminidase__InfluenzaA__AFN11847

SEQ ID NO: 205683 - RNA, 1410 nt, Artificial Sequence
  derived and/or modified sequence opt5 from neuraminidase__InfluenzaA__AFN11848
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccugggcccgaacaaugaggaagggggacacggcgugaaagggugggccuucgacgauggaaacgacguuuggaugggccggacgaucagcgagaagcuccgcucuggguacgagacauuuaaagugaucgaaggaugguccaauccuaacagcaagcugcagauuaauagacaggucaucguggaucggggcaaccgcucuggcuauuccgggauuuucagcgucgagggaaaauccuguaucaauagaugcuuuuacguggaacugauucggggcagaaagcaggagaccgaaguucucuggaccucuaacagcaucguggucuucugugggacauccggaaccuauggcacagggucuuggcccgacggcgcugauauuaaucugaugccuaucuga

SEQ ID NO: 205684 - RNA, 1410 nt, Artificial Sequence
  derived and/or modified sequence opt5 from neuraminidase__InfluenzaA__AFN11850
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucggggccgcacgccguauagaacacuccugaugaaugaacugggggugcccuuucaccucggaaccaagcaggucugcauugccugguccucuagcuccugucaugauggcaaagccuggcugcacgugugcaucacaggcgacgauaagaacgcuaccgccagcuucauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuauccuagauaccccggggugcggugugucugccgcgauaacuggaagggaagcaauagaccuaucguggacauuaacaucaaagaucacucuauuguuuccagcuacguguguucuggccuugucggcgacacgccccggaagaaugacagcuccucuagcucccauugccuggauccgaacaaugaggaagggggacacggcgugaaagggugggccuucgacgauggaaacgacguuuggaugggccgcaccaucagcgagaagucuagacucggguaugagacauuuaaagugaucgaaggaugguccaaucauaagagcaaacugcagauuaaccggcaggucaucguggaucgcggcaauagaucuggcuacuccgggauuuucagcgucgagggaaaguccuguaucaaccggugcuuuuauguggaacugauuagaggccgcaaggaggaaaccgagguucucuggaccucuaauagcaucguggucuucugugggacauccggaaccuacggcacagggucuuggccugacggcgcugaucugaaccuuaugcccauuuga

SEQ ID NO: 205685 - RNA, 1410 nt, Artificial Sequence
  derived and/or modified sequence opt5 from neuraminidase__InfluenzaA__AFN11851
augaaccccaaucagaagaucauuaccaucggcagcgugucccugacaauugccacgaucugccuccugaugcaaauugcuauccuugucaccacaguuacccugcacuucaaacaguacgaguguaacucuccuccgaauaaccaggugaugcucugcgaacccacaaucauugagagaaauaucaccaagauuguguaucugacaaacaccacgaucgaaaaagagauuuguccuaaacuugccgaauaccggaauuggagcaaaccccagugcaagaucaccggguuugcgccuuucuccaaggacaacucuauucgccugagcgcuggaggcgauaucugggucacaagagagcccuauguguccugugacccugggaaaugcuaccaauuugcccucggacagggcaccacacugaauaaccggcauucuaaugauaccguucacgaccgcacgccguauagaacacugcucaugaacgagcugggggugcccuuccaucuuggaaccaagcaggucuguaucgccuggagcuccagcucuugccacgauggcaaggcuuggcugcauguguguguuacaggccacgacgaaaaugccaccgcuuccuuuauuuacgaugggcggcucguggacagcaucggaucuugguccaagaacauucugcgcacccaggagagcgaaugcgucuguaucaauggcacaugcacgguggugaugaccgaugggucugccuccgagagagcggacacaaaaauucuuuucaucgaggaaggaaagaucguccacauuagcccucuguccggcucugcccaacauguugaggaaugcagcuguuauccccgguacccuggggugcgcugcguguguagagauaacuggaagggauccaaccggcccaucgucgacauuaaugugaaagauuacagcaucguuucuuccuaugugugcagcggccucgucggcgacaccccgcgcaagaacgacucuagcuccucuagcuacuguagaaauccuaacaaugagaaagggucccacggagugaagggcugggcuuuugaugacgggaacgauguuuggaugggacggacaauuagcgaggaacugcgcucuggcuaugagaccuucaaagugaucgggggaugguccaagcccaauagcaaacugcagaucaacagacaggucauuguggaccggggcaauagaucuggcuacuccgggaucuuuagcgucgaaggaaaguccugcauuaaccgcuguuucuauguggagcucauccggggcagaaagcaggaaacggagguuugguggacaucuaauagcauuguggucuuuugcgggaccuccggaaccuacggcacagggucuuggccugauggcgccgacaucaaccugaugcccauuuga

SEQ ID NO: 205686 - RNA, 1410 nt, Artificial Sequence; identical to SEQ ID NO: 197351
  derived and/or modified sequence opt5 from neuraminidase__InfluenzaA__AFN11853

SEQ ID NO: 205687 - RNA, 1410 nt, Artificial Sequence
  derived and/or modified sequence opt5 from neuraminidase__InfluenzaA__AFN11855
augaaccccaaucagaagaucauuaccaucggcagcgugucccugacaauuucuacgaucugcuucuuuaugcaaaccgccauucucaucacaaucgucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcaucacaggcgacgauaagaaugcuaccgccagcuucauuuacaacggcagacuuguugacucuaucguguccuggagcaaagagauucugcggacccaggaaucugagugugucugcaucaaugggacauguacgguggugaugaccgauggauccgcuagcggcaaggccgacacaaaaauccucuuuauugaggaagggaagaucguccacaccuccauucugucuggaagcgcgcaacacguugaggaaugcuccugcuauccucgcuaccccggcgugagaugugugugccgggauaacuggaaggggagcaaccgcccuaucgucgacauuaauaucaaagaccauucuaucguguccagcuacguuuguucuggacuugugggcgauacacccagaaagaacgacagcuccucuagcucccacugccuggauccgaauaacgaggaaggcgggcauggagucaaaggcugggccuucgacgaugggaaugacguguggaugggacggaccauuagcgagaagucucgccucggcuaugagacguuuaaaguuaucgaagggugguccaacccuaagagcaaacugcagauuaauagacaggugaucgucgaucggggaaaccgcucuggcuacuccggcauuuucagcguggaggggaaguccuguaucaauagaugcuuuuaugucgaacugauucggggaagaaaggaggaaacagaggugcucuggaccucuaacagcaucguuguguucuguggcaccuccgggacauacggaaccggcucuuggcccgacggggcugauaucaaucugaugccuauuuga

SEQ ID NO: 205688 - RNA, 1410 nt, Artificial Sequence; identical to SEQ ID NO: 198953
  derived and/or modified sequence opt5 from neuraminidase__InfluenzaA__AFN11857

SEQ ID NO: 205689 - RNA, 1410 nt, Artificial Sequence; identical to SEQ ID NO: 199762
  derived and/or modified sequence opt5 from neuraminidase__InfluenzaA__AFN17373

SEQ ID NO: 205690 - RNA, 1410 nt, Artificial Sequence; identical to SEQ ID NO: 205395
  derived and/or modified sequence opt5 from neuraminidase__InfluenzaA__AFN17383

SEQ ID NO: 205691 - RNA, 1410 nt, Artificial Sequence; identical to SEQ ID NO: 199762
  derived and/or modified sequence opt5 from neuraminidase__InfluenzaA__AFN17393

SEQ ID NO: 205692 - RNA, 1410 nt, Artificial Sequence; identical to SEQ ID NO: 199762
  derived and/or modified sequence opt5 from neuraminidase__InfluenzaA__AFN17403

SEQ ID NO: 205693 - RNA, 1410 nt, Artificial Sequence; identical to SEQ ID NO: 199762
  derived and/or modified sequence opt5 from neuraminidase__InfluenzaA__AFN17413

SEQ ID NO: 205694 - RNA, 1410 nt, Artificial Sequence; identical to SEQ ID NO: 199762
  derived and/or modified sequence opt5 from neuraminidase__InfluenzaA__AFN17423

SEQ ID NO: 205695 - RNA, 1410 nt, Artificial Sequence; identical to SEQ ID NO: 199762
  derived and/or modified sequence opt5 from neuraminidase__InfluenzaA__AFN17433

SEQ ID NO: 205696 - RNA, 1410 nt, Artificial Sequence; identical to SEQ ID NO: 199762
  derived and/or modified sequence opt5 from neuraminidase__InfluenzaA__AFN17443

SEQ ID NO: 205697 - RNA, 1410 nt, Artificial Sequence; identical to SEQ ID NO: 199762
  derived and/or modified sequence opt5 from neuraminidase__InfluenzaA__AFN17453

SEQ ID NO: 205698 - RNA, 1410 nt, Artificial Sequence; identical to SEQ ID NO: 199762
  derived and/or modified sequence opt5 from neuraminidase__InfluenzaA__AFN17459

SEQ ID NO: 205699 - RNA, 1410 nt, Artificial Sequence; identical to SEQ ID NO: 199762
  derived and/or modified sequence opt5 from neuraminidase__InfluenzaA__AFN17469

SEQ ID NO: 205700 - RNA, 1410 nt, Artificial Sequence; identical to SEQ ID NO: 199762
  derived and/or modified sequence opt5 from neuraminidase__InfluenzaA__AFN17479

SEQ ID NO: 205701 - RNA, 1410 nt, Artificial Sequence; identical to SEQ ID NO: 199762
  derived and/or modified sequence opt5 from neuraminidase__InfluenzaA__AFN17489

SEQ ID NO: 205702 - RNA, 1410 nt, Artificial Sequence; identical to SEQ ID NO: 199762
  derived and/or modified sequence opt5 from neuraminidase__InfluenzaA__AFN17499

SEQ ID NO: 205703 - RNA, 1410 nt, Artificial Sequence; identical to SEQ ID NO: 199762
  derived and/or modified sequence opt5 from neuraminidase__InfluenzaA__AFN17509

SEQ ID NO: 205704 - RNA, 1410 nt, Artificial Sequence; identical to SEQ ID NO: 199762
  derived and/or modified sequence opt5 from neuraminidase__InfluenzaA__AFN17519

SEQ ID NO: 205705 - RNA, 1410 nt, Artificial Sequence; identical to SEQ ID NO: 199762
  derived and/or modified sequence opt5 from neuraminidase__InfluenzaA__AFN17529

SEQ ID NO: 205706 - RNA, 1410 nt, Artificial Sequence; identical to SEQ ID NO: 199762
  derived and/or modified sequence opt5 from neuraminidase__InfluenzaA__AFN17539

SEQ ID NO: 205707 - RNA, 1410 nt, Artificial Sequence; identical to SEQ ID NO: 199762
  derived and/or modified sequence opt5 from neuraminidase__InfluenzaA__AFN17549

SEQ ID NO: 205708 - RNA, 1410 nt, Artificial Sequence; identical to SEQ ID NO: 199762
  derived and/or modified sequence opt5 from neuraminidase__InfluenzaA__AFN17559

SEQ ID NO: 205709 - RNA, 1410 nt, Artificial Sequence; identical to SEQ ID NO: 199762
  derived and/or modified sequence opt5 from neuraminidase__InfluenzaA__AFN17569

SEQ ID NO: 205710 - RNA, 1410 nt, Artificial Sequence; identical to SEQ ID NO: 199762
  derived and/or modified sequence opt5 from neuraminidase__InfluenzaA__AFN17575

SEQ ID NO: 205711 - RNA, 1410 nt, Artificial Sequence; identical to SEQ ID NO: 199762
  derived and/or modified sequence opt5 from neuraminidase__InfluenzaA__AFN17581

SEQ ID NO: 205712 - RNA, 1410 nt, Artificial Sequence; identical to SEQ ID NO: 199762
  derived and/or modified sequence opt5 from neuraminidase__InfluenzaA__AFN17587

SEQ ID NO: 205713 - RNA, 1410 nt, Artificial Sequence; identical to SEQ ID NO: 199762
  derived and/or modified sequence opt5 from neuraminidase__InfluenzaA__AFN17597

SEQ ID NO: 205714 - RNA, 1410 nt, Artificial Sequence; identical to SEQ ID NO: 205395
  derived and/or modified sequence opt5 from neuraminidase__InfluenzaA__AFN17607

SEQ ID NO: 205715 - RNA, 1410 nt, Artificial Sequence; identical to SEQ ID NO: 199762
  derived and/or modified sequence opt5 from neuraminidase__InfluenzaA__AFN17617

SEQ ID NO: 205716 - RNA, 1410 nt, Artificial Sequence; identical to SEQ ID NO: 199762
  derived and/or modified sequence opt5 from neuraminidase__InfluenzaA__AFN17627

SEQ ID NO: 205717 - RNA, 1410 nt, Artificial Sequence; identical to SEQ ID NO: 199762
  derived and/or modified sequence opt5 from neuraminidase__InfluenzaA__AFN17637

SEQ ID NO: 205718 - RNA, 1410 nt, Artificial Sequence; identical to SEQ ID NO: 199762
  derived and/or modified sequence opt5 from neuraminidase__InfluenzaA__AFN17647

SEQ ID NO: 205719 - RNA, 1410 nt, Artificial Sequence; identical to SEQ ID NO: 199762
  derived and/or modified sequence opt5 from neuraminidase__InfluenzaA__AFN17657

SEQ ID NO: 205720 - RNA, 1410 nt, Artificial Sequence; identical to SEQ ID NO: 199762
  derived and/or modified sequence opt5 from neuraminidase__InfluenzaA__AFN17667

SEQ ID NO: 205721 - RNA, 1410 nt, Artificial Sequence; identical to SEQ ID NO: 199762
  derived and/or modified sequence opt5 from neuraminidase__InfluenzaA__AFN17677

SEQ ID NO: 205722 - RNA, 1410 nt, Artificial Sequence; identical to SEQ ID NO: 205395
  derived and/or modified sequence opt5 from neuraminidase__InfluenzaA__AFN17687

SEQ ID NO: 205723 - RNA, 1410 nt, Artificial Sequence; identical to SEQ ID NO: 199762
  derived and/or modified sequence opt5 from neuraminidase__InfluenzaA__AFN17697

SEQ ID NO: 205724 - RNA, 1410 nt, Artificial Sequence; identical to SEQ ID NO: 205395
  derived and/or modified sequence opt5 from neuraminidase__InfluenzaA__AFN17707

SEQ ID NO: 205725 - RNA, 1410 nt, Artificial Sequence; identical to SEQ ID NO: 199762
  derived and/or modified sequence opt5 from neuraminidase__InfluenzaA__AFN17717

SEQ ID NO: 205726 - RNA, 1410 nt, Artificial Sequence; identical to SEQ ID NO: 205395
  derived and/or modified sequence opt5 from neuraminidase__InfluenzaA__AFN17727

SEQ ID NO: 205727 - RNA, 1410 nt, Artificial Sequence; identical to SEQ ID NO: 199762
  derived and/or modified sequence opt5 from neuraminidase__InfluenzaA__AFN17737

SEQ ID NO: 205728 - RNA, 1410 nt, Artificial Sequence; identical to SEQ ID NO: 199762
  derived and/or modified sequence opt5 from neuraminidase__InfluenzaA__AFN17743

SEQ ID NO: 205729 - RNA, 1410 nt, Artificial Sequence; identical to SEQ ID NO: 205395
  derived and/or modified sequence opt5 from neuraminidase__InfluenzaA__AFN17749

SEQ ID NO: 205730 - RNA, 1410 nt, Artificial Sequence; identical to SEQ ID NO: 199762
  derived and/or modified sequence opt5 from neuraminidase__InfluenzaA__AFN17759

SEQ ID NO: 205731 - RNA, 1410 nt, Artificial Sequence; identical to SEQ ID NO: 199762
  derived and/or modified sequence opt5 from neuraminidase__InfluenzaA__AFN17769

SEQ ID NO: 205732 - RNA, 1410 nt, Artificial Sequence; identical to SEQ ID NO: 199762
  derived and/or modified sequence opt5 from neuraminidase__InfluenzaA__AFN17775

SEQ ID NO: 205733 - RNA, 1410 nt, Artificial Sequence
  derived and/or modified sequence opt5 from neuraminidase__InfluenzaA__AFN17785
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucacccugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuugaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauacauuuagcaucaagcaagacaucguuggcauuaacgaaugguccggguacucuggcagcuucgugcagcaucccgagcugacgggacucgauuguauccgcccuugcuucugggucgaacugauuagaggccggcccaaagagaauaccaucuggacauccgggagcucuauuuccuuuuguggagugaacagcgacaccguuggcuggucuuggcccgauggggcugagcuuccuuucacaaucgacaaguga

SEQ ID NO: 205734 - RNA, 1410 nt, Artificial Sequence
  derived and/or modified sequence opt5 from neuraminidase__InfluenzaA__AFN17795
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuggcgggugggcuauuuacuccaaggacaacagcaucagaaucggaucuaaaggcgauguguuugucauucgggagccguucaucuccuguagcccccucgaaugccgcaccuuuuuccugacacagggcgcccuucugaaugacaagcauucuaacgggaccauuaaagauagauccccuuaucggacgcucaugagcugucccaucggagaggugccuucucccuacaacucccgcuuugaaagcguugccugguccgcuucugccugccacgacggcauuaauuggcugaccaucgggaucagcggaccugauaacggcgcuguggccguccugaaguauaaugggauuaucacagacaccauuaaguccuggagaaacaauauccuccggacacaagagagcgagugugcgugcgugaacggaucuuguuucaccgugaugacggauggcccguccgacggccaggccagcuacaaaauuuuucgcaucgaaaaggggaaaaucgucaagucuguugagaugaaugcucccaacuaucauuacgaagagugcagcuguuacccugauuccucugagauuacaugcgugugcagagacaauuggcacggaagcaaccggcccuggguguccuucaaucagaaccuggaauaucagaucggcuacauuuguagcgggaucuuuggagauaauccucgccccaacgacaaaaccggcucuugcgggccggucuccagcaauggagccaacggcgugaagggcuucucuuuuaaguaugggaacggaguuuggauuggcagaacaaaauccaucagcucccggaauggguucgagaugauuugggauccuaacggauggaccggcaccgacaauaacuuuucuaucaagcaagacaucguggggauuaaugaauggagcggcuacuccggaucuuucguccagcaucccgagcuuacaggccuggauuguauccgcccuugcuucuggguggaacucauuagagggcggcccaaagagaacacgaucuggaccagcggauccagcauuucuuuuuguggcguuaauuccgacacagugggguggagcuggcccgauggagcugagcugccuuucaccaucgacaaguga

SEQ ID NO: 205735 - RNA, 1410 nt, Artificial Sequence; identical to SEQ ID NO: 199762
  derived and/or modified sequence opt5 from neuraminidase__InfluenzaA__AFN17805

SEQ ID NO: 205736 - RNA, 1410 nt, Artificial Sequence
  derived and/or modified sequence opt5 from neuraminidase__InfluenzaA__AFN17815
augaaccccaaucagaagaucauuaccaucggcagcguguccaugacaauugggauggccaaccugauccuccaaauuggaaauaucaucucuauuuggaucagccacuccauucagcugggcaaccagaaucagaucgagacgugcaaccaaucugucauuaccuacgaaaauaacacauggguuaaucagaccuaugugaacaucagcaauacaaacuucgcugccgggcaguccguggucucugugaaacuugcgggaaauagcucccuguguccuguuagcggcugggcuauuuacucuaaggacaacuccaucagaaucgggagcaaaggagauguguuugucauucgggagccguucaucucuugcagcccccucgaaugucgcaccuuuuuccugacacagggcgcccuucugaaugacaagcauuccaacggcaccauuaaagauagaucuccuuaucggacgcucauguccugccccaucggggaggugccuagccccuacaacucccgcuuugaaucuguugccuggagcgcuuccgccugucacgacggaauuaauuggcugaccaucggcaucagcgggccugauaacggagcuguggccguccugaaguauaauggcauuaucacagacaccauuaagucuuggagaaacaauauccuccggacacaagaguccgagugcgcgugugugaacgggagcugcuucaccgugaugacggauggaccgucugacggccaggccagcuacaaaauuuuucgcaucgaaaagggcaaaaucgucaaguccguugagaugaaugcucccaacuaucauuacgaagaguguucuugcuacccugauagcuccgagauuacaugugugugcagagacaauuggcacgggagcaaccggcccugggugucuuucaaucagaaccuggaauaucagaucggauacauuugcuccggcaucuuuggggauaauccucgccccaacgacaaaaccggaagcuguggcccggucucuuccaauggggccaacggagugaagggcuucagcuuuaaguauggcaacgggguuuggauuggaagaacaaaauccaucucuagccggaauggcuucgagaugauuugggauccuaacggguggaccggaaccgacaauaacuuuuccaucaagcaagacaucgugggcauuaaugaauggucuggguacagcggcuccuucguccagcaucccgagcuuacaggacuggauugcauccgcccuuguuucuggguggaacucauuagaggccggcccaaagagaacacgaucuggaccagcgggucuuccauuagcuuuugcggaguuaauucugacacagugggcugguccuggcccgauggggcugagcugccuuucaccaucgacaaguga

SEQ ID NO: 205737 - RNA, 1410 nt, Artificial Sequence; identical to SEQ ID NO: 199762
  derived and/or modified sequence opt5 from neuraminidase__InfluenzaA__AFN17825

SEQ ID NO: 205738 - RNA, 1410 nt, Artificial Sequence; identical to SEQ ID NO: 205395
  derived and/or modified sequence opt5 from neuraminidase__InfluenzaA__AFN17835

SEQ ID NO: 205739 - RNA, 1410 nt, Artificial Sequence; identical to SEQ ID NO: 199762
  derived and/or modified sequence opt5 from neuraminidase__InfluenzaA__AFN17845

SEQ ID NO: 205740 - RNA, 1410 nt, Artificial Sequence; identical to SEQ ID NO: 199762
  derived and/or modified sequence opt5 from neuraminidase__InfluenzaA__AFN17855

SEQ ID NO: 205741 - RNA, 1410 nt, Artificial Sequence; identical to SEQ ID NO: 201576
  derived and/or modified sequence opt5 from neuraminidase__InfluenzaA__AFN17865

SEQ ID NO: 205742 - RNA, 1410 nt, Artificial Sequence; identical to SEQ ID NO: 205395
  derived and/or modified sequence opt5 from neuraminidase__InfluenzaA__AFN17875

SEQ ID NO: 205743 - RNA, 1410 nt, Artificial Sequence; identical to SEQ ID NO: 205395
  derived and/or modified sequence opt5 from neuraminidase__InfluenzaA__AFN17885

SEQ ID NO: 205744 - RNA, 1410 nt, Artificial Sequence; identical to SEQ ID NO: 199762
  derived and/or modified sequence opt5 from neuraminidase__InfluenzaA__AFN17895

SEQ ID NO: 205745 - RNA, 1410 nt, Artificial Sequence; identical to SEQ ID NO: 205395
  derived and/or modified sequence opt5 from neuraminidase__InfluenzaA__AFN17905

SEQ ID NO: 205746 - RNA, 1410 nt, Artificial Sequence; identical to SEQ ID NO: 199762
  derived and/or modified sequence opt5 from neuraminidase__InfluenzaA__AFN17911

SEQ ID NO: 205747 - RNA, 1410 nt, Artificial Sequence; identical to SEQ ID NO: 205395
  derived and/or modified sequence opt5 from neuraminidase__InfluenzaA__AFN17921

SEQ ID NO: 205748 - RNA, 1410 nt, Artificial Sequence
  derived and/or modified sequence opt5 from neuraminidase__InfluenzaA__AFN17931
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucgggucccggggagauguguuugucauucgcgagccguucaucagcuguucuccccucgaaugcagaaccuuuuuccugacacagggcgcccuucugaaugacaaacauuccaacggcaccauuaaggaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauauagaaucggauacauuuguucuggcaucuuuggggauaauccucggcccaacgacaagaccggauccugcggcccggucagcucuaauggggccaacggagugaaaggcuucuccuuuaaguauggcaacgggguuuggauuggacgcacaaagagcaucuccucuagaaauggcuucgagaugauuugggauccuaacggguggaccggaaccgacaauaacuuuagcaucaaacaggacaucgugggcauuaaugaaugguccggguacucuggcagcuucguccaacaucccgagcuuacaggacuggauuguauccggccuugcuucuggguggaacucauucgcggcagacccaaggagaacacgaucuggaccuccgggagcucuauuuccuuuuguggaguuaauagcgacacagugggcuggucuuggcccgauggggcugagcugccuuucaccaucgacaaauga

SEQ ID NO: 205749 - RNA, 1410 nt, Artificial Sequence; identical to SEQ ID NO: 199762
  derived and/or modified sequence opt5 from neuraminidase__InfluenzaA__AFN17941

SEQ ID NO: 205750 - RNA, 1410 nt, Artificial Sequence; identical to SEQ ID NO: 199762
  derived and/or modified sequence opt5 from neuraminidase__InfluenzaA__AFN17951

SEQ ID NO: 205751 - RNA, 1410 nt, Artificial Sequence
  derived and/or modified sequence opt5 from neuraminidase__InfluenzaA__AFN17961
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaauagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaacggagugaaaggcuucuccuuuaaguauggcaaugggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 205752 - RNA, 1410 nt, Artificial Sequence; identical to SEQ ID NO: 199762
  derived and/or modified sequence opt5 from neuraminidase__InfluenzaA__AFN17971

SEQ ID NO: 205753 - RNA, 1410 nt, Artificial Sequence; identical to SEQ ID NO: 199762
  derived and/or modified sequence opt5 from neuraminidase__InfluenzaA__AFN17981

SEQ ID NO: 205754 - RNA, 1410 nt, Artificial Sequence; identical to SEQ ID NO: 199762
  derived and/or modified sequence opt5 from neuraminidase__InfluenzaA__AFN17991

SEQ ID NO: 205755 - RNA, 1410 nt, Artificial Sequence
  derived and/or modified sequence opt5 from neuraminidase__InfluenzaA__AFN18001
augaaccccaaucagaagaucauuaccaucagcuccgugugcaugacaauuggcauggccaaccugauccuccaaauugggaauaucaucucuauuuggaucagccacuccauucagcugggaaaccagaaucagaucgagacguguaaccaaucugucauuaccuacgaaaauaacacauggguuaaucagaccuaugugaacaucagcaauacaaacuucgcugccggccaguccguggucucugugaaacuugcggggaauagcucccugugcccuguuagcggaugggcuauuuacucuaaggacaacuccaucagaaucggcagcaaaggggauguguuugucauucgggagccguucaucucuuguucuccccucgaaugccgcaccuuuuuccugacacagggagcccuucugaaugacaagcauagcaacggcaccauuaaagauagaucuccuuaucggacgcucauguccugucccaucggcgaggugccuagccccuacaacucccgcuuugaaucuguugccuggagcgcuuccgccugccacgacgggauuaauuggcugaccaucggaaucagcggcccugauaacggggcuguggccguccugaaguauaauggaauuaucacagacaccauuaagucuuggagaaacaauauccuccggacacaagaguccgagugugcgugcgugaacggcagcuguuucacccugaugacggaugggccgucugacggacaggccagcuacaaaauuuuucgcaucgaaaagggcaaaaucgugaaguccgucgagaugaaugcucccaacuaucauuacgaagagugcucuuguuacccugauagcuccgagauuacaugcguuugcagagacaauuggcacggcagcaaccggcccugggugucuuucaaucagaaccuugaauaucagaucggguacauuuguuccggaaucuuuggcgauaauccucgccccaacgacaaaaccgggagcugcggaccggugucuuccaauggcgccaacggggucaagggauucagcuuuaaguauggcaacggcguguggauugggagaacaaaauccaucucuagccggaauggauucgagaugauuugggauccuaacggcuggaccgggaccgacaauaacuuuuccaucaagcaagacaucguuggaauuaaugaauggucuggcuacagcggguccuucgugcagcaucccgagcugacaggccucgauuguauccgcccuugcuucugggucgaacugauuagaggacggcccaaagagaacacgaucuggaccagcggcuccuccauuagcuuuugugggguuaauucugacacagugggaugguccuggcccgauggcgcugagcuuccuuucaccaucgacaaguga

SEQ ID NO: 205756 - RNA, 1410 nt, Artificial Sequence; identical to SEQ ID NO: 199762
  derived and/or modified sequence opt5 from neuraminidase__InfluenzaA__AFN18011

SEQ ID NO: 205757 - RNA, 1410 nt, Artificial Sequence; identical to SEQ ID NO: 199762
  derived and/or modified sequence opt5 from neuraminidase__InfluenzaA__AFN18021

SEQ ID NO: 205758 - RNA, 1410 nt, Artificial Sequence
  derived and/or modified sequence opt5 from neuraminidase__InfluenzaA__AFN18031
augaaccccaaucagaagaucauuaccaucggcagcauuugcaugacaaucgggauggccaaccugauucuccaaaucggaaauaucauuuccaucuggauuucucacagcauccagcugggcaaccagaaucagauugagacguguaaccaauccgugaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucacccugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcgugugcagagacaauuggcacggguccaaccggcccuggguuagcuucaaucagaaccuugaauaucagauuggauacaucuguucuggcauuuuuggggauaauccucgccccaacgacaaaaccggauccugcggcccggugagcucuaauggggccaacggagugaagggcuucuccuuuaaguauggcaacggggucuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguucagcaucccgagcugacaggacucgauuguauucgcccuugcuucuggguggaacugaucagaggccggcccaaagagaacacgauuuggaccuccgggagcucuaucuccuuuuguggagucaauagcgacacagugggcuggucuuggcccgauggggcugagcuuccuuucaccaucgacaaguga

SEQ ID NO: 205759 - RNA, 1410 nt, Artificial Sequence; identical to SEQ ID NO: 199762
  derived and/or modified sequence opt5 from neuraminidase__InfluenzaA__AFN18041

SEQ ID NO: 205760 - RNA, 1410 nt, Artificial Sequence; identical to SEQ ID NO: 205395
  derived and/or modified sequence opt5 from neuraminidase__InfluenzaA__AFN18051

SEQ ID NO: 205761 - RNA, 1410 nt, Artificial Sequence; identical to SEQ ID NO: 205395
  derived and/or modified sequence opt5 from neuraminidase__InfluenzaA__AFN18061

SEQ ID NO: 205762 - RNA, 1410 nt, Artificial Sequence; identical to SEQ ID NO: 199762
  derived and/or modified sequence opt5 from neuraminidase__InfluenzaA__AFN18070

SEQ ID NO: 205763 - RNA, 1410 nt, Artificial Sequence; identical to SEQ ID NO: 199762
  derived and/or modified sequence opt5 from neuraminidase__InfluenzaA__AFN18080

SEQ ID NO: 205764 - RNA, 1410 nt, Artificial Sequence; identical to SEQ ID NO: 199762
  derived and/or modified sequence opt5 from neuraminidase__InfluenzaA__AFN18090

SEQ ID NO: 205765 - RNA, 1410 nt, Artificial Sequence; identical to SEQ ID NO: 199762
  derived and/or modified sequence opt5 from neuraminidase__InfluenzaA__AFN18100

SEQ ID NO: 205766 - RNA, 1410 nt, Artificial Sequence; identical to SEQ ID NO: 199762
  derived and/or modified sequence opt5 from neuraminidase__InfluenzaA__AFN18106

SEQ ID NO: 205767 - RNA, 1410 nt, Artificial Sequence
  derived and/or modified sequence opt5 from neuraminidase__InfluenzaA__AFN18108
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccgguccuuagcaauggggccaacggagugaagggcuucucuuuuaaguauggcaacgggguuuggauuggacggacaaaauccaucagcucccgcaauggcuucgagaugauuugggauccuaacggguggaccggaaccgacaauaacuuuucuaucaagcaggacaucgugggcauuaaugaauggagcggguacuccggcucuuucguccaacaucccgagcugacaggacucgauuguaucagaccuugcuucuggguggaacugauucggggccgccccaaagagaacacgaucuggaccagcggguccagcauuucuuuuuguggaguuaauuccgacacagugggcuggagcuggcccgauggggcugagcuuccuuucaccaucgacaaguga

SEQ ID NO: 205768 - RNA, 1410 nt, Artificial Sequence
  derived and/or modified sequence opt5 from neuraminidase__InfluenzaA__AFN18118
augaaccccaaucagaagaucauuaccaucggcagcgugugcaugacaauugggauggccaaccugauccuccaaauuggaaauaugaucuccaucuggauuucucacagcauccagcugggcaaccagaaucagauugagacguguaaccaauccgucaucaccuacgaaaauaacacauggguuaaucagaccuaugugaaaauuucuaacacaaauuucgcugccgggcagagcguggucuccgugaaacuugcgggaaacucuagccugugcccuguuuccggcugggcuaucuacagcaaggacaauucuauuagaaucggguccaagggagauguguuugucauccgggagccguucauuagcuguucuccccucgaaugccgcaccuuuuuccugacacagggcgcccuucugaacgacaaacauuccaauggcaccaucaaggauagaagcccuuaucggacgcucaugucuugucccauuggggaggugccuucccccuacaacagccgcuuugaauccguugccuggucugcuagcgccugccacgacggaaucaacuggcugaccauuggcaucuccgggccugauaauggagcuguggccguccugaaguauaacggcaucauuacagacaccaucaaaagcuggagaaauaacauucuccggacacaagagucugagugugcgugcgugaauggguccuguuucacccugaugacggauggaccgagcgacggccaggccucuuacaagaucuuucgcauugaaaaaggcaagaucgugaaaagcgucgagaugaacgcucccaauuaucauuacgaagagugcuccuguuacccugauucuagcgagaucacaugcguuugcagagacaacuggcacggguccaaucggcccugggugagcuucaaccagaaucuugaauaucagauuggauacaucuguucuggcauuuuuggggauaacccucgccccaaugacaagaccggauccugcggcccggugagcucuaacggggccaauggagucaagggcuucuccuuuaaauauggcaacgggguguggaucggaagaacaaagagcauuuccucucggaacggcuucgagaugaucugggauccuaauggguggaccggaaccgacaacaauuuuagcauuaaacaagacaucguuggcaucaacgaaugguccggguacucuggcagcuucgugcagcaucccgagcugacaggacucgauuguauucgcccuugcuucugggucgaacugaucagaggccggcccaaggagaauacgauuuggaccuccgggagcucuaucuccuuuuguggagugaacagcgacacaguuggcuggucuuggcccgauggggcugagcuuccuuucaccauugacaaauga

SEQ ID NO: 205769 - RNA, 1410 nt, Artificial Sequence; identical to SEQ ID NO: 199762
  derived and/or modified sequence opt5 from neuraminidase__InfluenzaA__AFN18120

SEQ ID NO: 205770 - RNA, 1410 nt, Artificial Sequence; identical to SEQ ID NO: 199762
  derived and/or modified sequence opt5 from neuraminidase__InfluenzaA__AFN18122

SEQ ID NO: 205771 - RNA, 1410 nt, Artificial Sequence; identical to SEQ ID NO: 205395
  derived and/or modified sequence opt5 from neuraminidase__InfluenzaA__AFN18128

SEQ ID NO: 205772 - RNA, 1410 nt, Artificial Sequence; identical to SEQ ID NO: 205395
  derived and/or modified sequence opt5 from neuraminidase__InfluenzaA__AFN18134

SEQ ID NO: 205773 - RNA, 1410 nt, Artificial Sequence; identical to SEQ ID NO: 199762
  derived and/or modified sequence opt5 from neuraminidase__InfluenzaA__AFN18136

SEQ ID NO: 205774 - RNA, 1410 nt, Artificial Sequence; identical to SEQ ID NO: 199762
  derived and/or modified sequence opt5 from neuraminidase__InfluenzaA__AFN18138

SEQ ID NO: 205775 - RNA, 1410 nt, Artificial Sequence
  derived and/or modified sequence opt5 from neuraminidase__InfluenzaA__AFN18140
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccggucagcucuaauggggccaacggagugaagggcuucuccuuuaaguauggcaacgggauuuggaucggacggacaaaaagcauuuccucucgcaauggcuucgagaugaucugggauccuaacggguggaccggaaccgacaauaacuuuagcaucaagcaggacauuguuggcaucaaugaaugguccggguacucuggcagcuucgugcaacaucccgagcuuacaggacuggauuguauuagaccuugcuucugggucgaacucauccggggccgccccaaagagaacacgauuuggaccuccgggagcucuaucuccuuuuguggagugaauagcgacacaguuggcuggucuuggcccgauggggcugagcugccuuucaccaucgacaaguga

SEQ ID NO: 205776 - RNA, 1410 nt, Artificial Sequence; identical to SEQ ID NO: 199762
  derived and/or modified sequence opt5 from neuraminidase__InfluenzaA__AFN18144

SEQ ID NO: 205777 - RNA, 1410 nt, Artificial Sequence; identical to SEQ ID NO: 199762
  derived and/or modified sequence opt5 from neuraminidase__InfluenzaA__AFN18150

SEQ ID NO: 205778 - RNA, 1410 nt, Artificial Sequence; identical to SEQ ID NO: 199762
  derived and/or modified sequence opt5 from neuraminidase__InfluenzaA__AFN18156

SEQ ID NO: 205779 - RNA, 1410 nt, Artificial Sequence; identical to SEQ ID NO: 199762
  derived and/or modified sequence opt5 from neuraminidase__InfluenzaA__AFN18158

SEQ ID NO: 205780 - RNA, 1410 nt, Artificial Sequence; identical to SEQ ID NO: 201576
  derived and/or modified sequence opt5 from neuraminidase__InfluenzaA__AFN18160

SEQ ID NO: 205781 - RNA, 1410 nt, Artificial Sequence
  derived and/or modified sequence opt5 from neuraminidase__InfluenzaA__AFN18166
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaaaacauggguuaaccagaccuaugugaauaucucuaacgcuaauuucgccgcggggcagagcguggucuccgugaaacuugcuggaaacucuagccugugcccuguuuccggcugggccauuuacagcaaggacaauucuaucagaaucggguccaagggagauguguuugucauucgggagccguucaucagcuguucuccccucgaaugccgcacauuuuuccugacccagggcgcccuucugaacgacaaacauuccaauggcacaauuaaggauagaagcccuuaucggacccucaugucuugucccaucggggaggugccuucccccuacaacagcaaguuugaauccguugcuuggucugccagcgcuugccacgacggaauuaacuggcugacgaucggcaucuccgggccugauaauggagccguggcgguccugaaauauaacggcauuaucaccgacacaauuaagagcuggcgcaauaacauccucagaacccaagagucugagugugccugcgugaauggguccuguuucacagugaugaccgauggaccgagcgacggccaggcuucuuacaaaauuuuucggaucgaaaagggcaaaaucgucaagagcguugagaugaacgcccccaauuaucauuacgaagagugcuccuguuacccugauucuagcgagauuacgugcgugugccgcgacaacuggcacggguccaauagacccugggugagcuucaaccagaaucuggaauaucagaucggauacauuuguucuggcaucuuuggggauaacccucggcccaaugacaagacaggauccugcggcccggucagcucuaacggggcuaauggagugaaaggcuucuccuuuaaguauggcaacgggguuuggauuggacgcaccaaaagcaucuccucuagaaacggcuucgagaugauuugggauccuaauggguggacaggaaccgacaacaauuuuagcaucaagcaagacaucgugggcauuaacgaaugguccggguacucuggcagcuucguccagcaucccgagcuuaccggacuggauuguauccggccuugcuucuggguggaacucauucgcggcagacccaaagagaauacaaucuggacguccgggagcucuauuuccuuuuguggaguuaacagcgacaccgugggcuggucuuggcccgauggggccgagcugccuuucacaaucgacaaguga

SEQ ID NO: 205782 - RNA, 1410 nt, Artificial Sequence; identical to SEQ ID NO: 199762
  derived and/or modified sequence opt5 from neuraminidase__InfluenzaA__AFN18172

SEQ ID NO: 205783 - RNA, 1410 nt, Artificial Sequence; identical to SEQ ID NO: 200780
  derived and/or modified sequence opt5 from neuraminidase__InfluenzaA__AFN18178

SEQ ID NO: 205784 - RNA, 1410 nt, Artificial Sequence
  derived and/or modified sequence opt5 from neuraminidase__InfluenzaA__AFN18184
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcaugguguccgucaaacuugcgggaaauucuagccugugcccuguguccggcugggcuauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggccuggucugcuagcgccugccacgacggaauuaauuggcugaccaucggcaucuccgggccugauaacggagcuguugccgugcugaaguauaauggcauuaucacagacaccauuaagagcuggagaaacaauauccuccggacacaagagucugagugugcgugcgucaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggcugagcugccuuucaccaucgacaaguga

SEQ ID NO: 205785 - RNA, 1410 nt, Artificial Sequence; identical to SEQ ID NO: 202754
  derived and/or modified sequence opt5 from neuraminidase__InfluenzaA__AFN18190

SEQ ID NO: 205786 - RNA, 1410 nt, Artificial Sequence; identical to SEQ ID NO: 203775
  derived and/or modified sequence opt5 from neuraminidase__InfluenzaA__AFN18196

SEQ ID NO: 205787 - RNA, 1410 nt, Artificial Sequence
  derived and/or modified sequence opt5 from neuraminidase__InfluenzaA__AFN18202
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggagaagcguggucuccgugaaacuugcgggaaauucuagccugugcccuguuuccggcugggcuauuuacagcaaggacaacucuauccggaucggguccaaaggagauguguuugucauucgcgagccguucaucagcuguucuccccucgaaugcagaaccuuuuuccugacacagggcgcccuucugaaugacaagcauuccaacggcaccauuaaagaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaguauaauggcauuaucacagacaccauuaagagcuggcggaacaauauccuccgcacacaggagucugagugugcgugcgugaacggguccuguuucaccgugaugacggauggaccgagcgacggccaagccucuuacaaaauuuuuagaaucgaaaagggcaaaaucgucaagagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucgugggcauuaaugaaugguccggguacucuggcagcuucguccaacaucccgagcuuacaggacuggauuguaucagaccuugcuucuggguggaacucauucggggccgccccaaagagaacacgaucuggaccuccgggagcucuauuuccuuuuguggaguuaauagcgacacagugggcuggucuuggcccgauggggcugagcugccuuucaccaucgacaaguga

SEQ ID NO: 205788 - RNA, 1410 nt, Artificial Sequence; identical to SEQ ID NO: 199762
  derived and/or modified sequence opt5 from neuraminidase__InfluenzaA__AFN18208

SEQ ID NO: 205789 - RNA, 1410 nt, Artificial Sequence
  derived and/or modified sequence opt5 from neuraminidase__InfluenzaA__AFN18210
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcgccuuuuuccugacccagggcgcccuucugaaugacaagcauuccaacggcacaauuaaagauagaagcccuuaucggacccucaugucuugucccaucggggaggugccuucccccuacaacagccgcuuugaauccguugcuuggucugccagcgcuugccacgacggaauuaauuggcugacgaucggcaucuccgggccugauaacggagccguggcgguccugaaguauaauggcauuaucaccgacacaauuaagagcuggagaaacaauauccuccggacccaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucgcaucggauacauuuguucuggcaucuuuggggauaauccuagacccaacgacaaaacaggauccugcggcccggucagcucuaauggggcuaacggagugaagggcuucuccuuuaaguauggcaacgggguuuggauuggacggaccaaaagcaucuccucucgcaauggcuucgagaugauuugggauccuaacggguggacaggaaccgacaauaacuuuagcaucaagcaggacaucgugggcauuaaugaaugguccggguacucuggcagcuucguccaacaucccgagcuuaccggacuggauuguaucagaccuugcuucuggguggaacucauucggggccgccugaaagagaacacaaucuggacguccgggagcucuauuuccuuuuguggaguuaauagcgacaccgugggcuggucuuggcccgauggggccgagcuucccuucacaaucgacaaguga

SEQ ID NO: 205790 - RNA, 1410 nt, Artificial Sequence; identical to SEQ ID NO: 200345
  derived and/or modified sequence opt5 from neuraminidase__InfluenzaA__AFN18216

SEQ ID NO: 205791 - RNA, 1410 nt, Artificial Sequence; identical to SEQ ID NO: 202091
  derived and/or modified sequence opt5 from neuraminidase__InfluenzaA__AFN18226

SEQ ID NO: 205792 - RNA, 1410 nt, Artificial Sequence; identical to SEQ ID NO: 199762
  derived and/or modified sequence opt5 from neuraminidase__InfluenzaA__AFN18232

SEQ ID NO: 205793 - RNA, 1410 nt, Artificial Sequence; identical to SEQ ID NO: 199762
  derived and/or modified sequence opt5 from neuraminidase__InfluenzaA__AFN18234

SEQ ID NO: 205794 - RNA, 1410 nt, Artificial Sequence; identical to SEQ ID NO: 199762
  derived and/or modified sequence opt5 from neuraminidase__InfluenzaA__AFN18244

SEQ ID NO: 205795 - RNA, 1410 nt, Artificial Sequence; identical to SEQ ID NO: 199762
  derived and/or modified sequence opt5 from neuraminidase__InfluenzaA__AFN18246

SEQ ID NO: 205796 - RNA, 1410 nt, Artificial Sequence; identical to SEQ ID NO: 202091
  derived and/or modified sequence opt5 from neuraminidase__InfluenzaA__AFN18256

SEQ ID NO: 205797 - RNA, 1410 nt, Artificial Sequence; identical to SEQ ID NO: 199762
  derived and/or modified sequence opt5 from neuraminidase__InfluenzaA__AFN18262

SEQ ID NO: 205798 - RNA, 1410 nt, Artificial Sequence; identical to SEQ ID NO: 199762
  derived and/or modified sequence opt5 from neuraminidase__InfluenzaA__AFN18268

SEQ ID NO: 205799 - RNA, 1410 nt, Artificial Sequence; identical to SEQ ID NO: 199762
  derived and/or modified sequence opt5 from neuraminidase__InfluenzaA__AFN18270

SEQ ID NO: 205800 - RNA, 1410 nt, Artificial Sequence; identical to SEQ ID NO: 202751
  derived and/or modified sequence opt5 from neuraminidase__InfluenzaA__AFN18272

SEQ ID NO: 205801 - RNA, 1410 nt, Artificial Sequence; identical to SEQ ID NO: 199762
  derived and/or modified sequence opt5 from neuraminidase__InfluenzaA__AFN18274

SEQ ID NO: 205802 - RNA, 1410 nt, Artificial Sequence; identical to SEQ ID NO: 199762
  derived and/or modified sequence opt5 from neuraminidase__InfluenzaA__AFN18282

SEQ ID NO: 205803 - RNA, 1410 nt, Artificial Sequence; identical to SEQ ID NO: 199762
  derived and/or modified sequence opt5 from neuraminidase__InfluenzaA__AFN18304

SEQ ID NO: 205804 - RNA, 1410 nt, Artificial Sequence
  derived and/or modified sequence opt5 from neuraminidase__InfluenzaA__AFN18306
augaaccccaaucagaagaucauuaccaucggcagcgugugcaugacaauugggaucgccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccaucggcauuuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccaucgacaaguga

SEQ ID NO: 205805 - RNA, 1410 nt, Artificial Sequence
  derived and/or modified sequence opt5 from neuraminidase__InfluenzaA__AFN18308
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaagggggccaauggagugaagggcuucuccuuuaaauauggcaacgggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 205806 - RNA, 1410 nt, Artificial Sequence
  derived and/or modified sequence opt5 from neuraminidase__InfluenzaA__AFN18314
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaagacgaucuggaccuccgggagcucuauuuccuuuuguggaguuaacagcgacacagugggcuggucuuggcccgauggggcugagcugccuuucaccaucgacaaauga

SEQ ID NO: 205807 - RNA, 1410 nt, Artificial Sequence; identical to SEQ ID NO: 199762
  derived and/or modified sequence opt5 from neuraminidase__InfluenzaA__AFN18320

SEQ ID NO: 205808 - RNA, 1410 nt, Artificial Sequence
  derived and/or modified sequence opt5 from neuraminidase__InfluenzaA__AFN18326
augaaccccaaucagaagaucauuaccaucggcagcgugugcaugacaauugggauggccaaccugcuccugcaaaucggaaauauuaucuccaucuggauuucucacagcauccagcuuggcaaccagaaucagauugagacguguaaccaauccgucaucaccuacgaaaauaacacauggguuaaucagaccuaugugaacauuucuaauacaaacuucgcugccgggcagagcguggucuccgugaaacuggcgggaaauucuagccucugcccuguuuccggcugggcuaucuacagcaaggacaacucuauuagaaucggguccaaaggagauguguuugucauccgggagccguucauuagcuguucuccccuggaaugccgcaccuuuuuccuuacacagggcgcccugcucaaugacaagcauuccaacggcaccaucaaagauagaagcccuuaucggacgcugaugucuugucccauuggggaggugccuucccccuacaacagccgcuuugaauccguugccuggucugcuagcgccugccacgacggaaucaauuggcugaccauuggcaucuccgggccugauaacggagcuguggccguccucaaguauaauggcaucauuacagacaccaucaagagcuggagaaacaauauucugcggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuugaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcugacaggacucgauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcuuccuuucaccauugacaaguga

SEQ ID NO: 205809 - RNA, 1410 nt, Artificial Sequence; identical to SEQ ID NO: 199762
  derived and/or modified sequence opt5 from neuraminidase__InfluenzaA__AFN18336

SEQ ID NO: 205810 - RNA, 1410 nt, Artificial Sequence; identical to SEQ ID NO: 199762
  derived and/or modified sequence opt5 from neuraminidase__InfluenzaA__AFN18346

SEQ ID NO: 205811 - RNA, 1410 nt, Artificial Sequence; identical to SEQ ID NO: 205395
  derived and/or modified sequence opt5 from neuraminidase__InfluenzaA__AFN18356

SEQ ID NO: 205812 - RNA, 1410 nt, Artificial Sequence
  derived and/or modified sequence opt5 from neuraminidase__InfluenzaA__AFN18366
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgagcagagcguggucuccgugaaacuugcgggaaauucuagccugugcccuguuuccgggugggcuauuuacagcaaggacaacucuaucagaaucggcuccaaaggggauguguuugucauucgggaaccguucaucagcuguucuccccucgagugccgcaccuuuuuccugacacagggagcccuucugaaugacaagcauuccaacggcaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcgugaacggcuccuguuucaccgugaugacggaugggccgagcgacggacaggccucuuacaaaauuuuucgcaucgagaagggcaaaaucgucaagagcguugaaaugaaugcucccaacuaucauuacgaggagugcuccuguuacccugauucuagcgaagugacaugcgugugcagagacaauuggcacggcuccaaccggcccugggucagcuucaaucagaaccuggaguaucagauuggguacaucuguucuggaauuuuuggcgauaauccucgccccaacgacaaaaccggguccugcggaccggugagcucuaauggcgccaacgggguuaagggauucuccuuuaaguauggcaacggcguguggaucgggagaacaaaaagcauuuccucucggaauggauucgaaaugaucugggauccuaacggcuggaccgggaccgacaauaacuuuagcauuaagcaagacaucgucggaaucaaugagugguccggcuacucugggagcuucgugcagcaucccgaacuuacaggccuggauuguauucgcccuugcuucuggguugagcucaucagaggacggcccaaagagaacacgauuuggaccuccggcagcucuaucuccuuuuguggggugaauagcgacacagucggauggucuuggcccgauggcgcugaacugccuuucaccauugacaaguga

SEQ ID NO: 205813 - RNA, 1410 nt, Artificial Sequence; identical to SEQ ID NO: 205395
  derived and/or modified sequence opt5 from neuraminidase__InfluenzaA__AFN18376

SEQ ID NO: 205814 - RNA, 1410 nt, Artificial Sequence; identical to SEQ ID NO: 199762
  derived and/or modified sequence opt5 from neuraminidase__InfluenzaA__AFN18382

SEQ ID NO: 205815 - RNA, 1410 nt, Artificial Sequence; identical to SEQ ID NO: 199762
  derived and/or modified sequence opt5 from neuraminidase__InfluenzaA__AFN18392

SEQ ID NO: 205816 - RNA, 1410 nt, Artificial Sequence; identical to SEQ ID NO: 199762
  derived and/or modified sequence opt5 from neuraminidase__InfluenzaA__AFN18402

SEQ ID NO: 205817 - RNA, 1410 nt, Artificial Sequence; identical to SEQ ID NO: 199762
  derived and/or modified sequence opt5 from neuraminidase__InfluenzaA__AFN18412

SEQ ID NO: 205818 - RNA, 1410 nt, Artificial Sequence; identical to SEQ ID NO: 199762
  derived and/or modified sequence opt5 from neuraminidase__InfluenzaA__AFN18422

SEQ ID NO: 205819 - RNA, 1410 nt, Artificial Sequence; identical to SEQ ID NO: 199762
  derived and/or modified sequence opt5 from neuraminidase__InfluenzaA__AFN18432

SEQ ID NO: 205820 - RNA, 1410 nt, Artificial Sequence; identical to SEQ ID NO: 199762
  derived and/or modified sequence opt5 from neuraminidase__InfluenzaA__AFN18442

SEQ ID NO: 205821 - RNA, 1410 nt, Artificial Sequence; identical to SEQ ID NO: 199762
  derived and/or modified sequence opt5 from neuraminidase__InfluenzaA__AFN18452

SEQ ID NO: 205822 - RNA, 1410 nt, Artificial Sequence; identical to SEQ ID NO: 199762
  derived and/or modified sequence opt5 from neuraminidase__InfluenzaA__AFN18462

SEQ ID NO: 205823 - RNA, 1410 nt, Artificial Sequence
  derived and/or modified sequence opt5 from neuraminidase__InfluenzaA__AFN18472
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaagggagugaagggcuucuccuuuaaauauggcaacgggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 205824 - RNA, 1410 nt, Artificial Sequence; identical to SEQ ID NO: 199762
  derived and/or modified sequence opt5 from neuraminidase__InfluenzaA__AFN18482

SEQ ID NO: 205825 - RNA, 1410 nt, Artificial Sequence; identical to SEQ ID NO: 199762
  derived and/or modified sequence opt5 from neuraminidase__InfluenzaA__AFN18492

SEQ ID NO: 205826 - RNA, 1410 nt, Artificial Sequence
  derived and/or modified sequence opt5 from neuraminidase__InfluenzaA__AFN18514
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuguuggaaauucuagccugugcccuguguccggcugggcgauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggcuuggucugccagcgcuugccacgacggaauuaauuggcugaccaucggcaucuccgggccugauaacggagccgucgcugugcugaaguauaauggcauuaucacagacaccauuaagagcuggagaaacaauauccuccggacacaagagucugagugugccugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucgucggcauuaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggccgagcugccuuucaccaucgacaaguga

SEQ ID NO: 205827 - RNA, 1410 nt, Artificial Sequence
  derived and/or modified sequence opt5 from neuraminidase__InfluenzaA__AFN18520
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcgugauuacagacaccaucaagagcuggagaaacaauauucuccggacacaagagucugagugugcgugcgugaacggguccuguuucacccugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuugaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcugacaggacucgauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcuuccuuucaccauugacaaguga

SEQ ID NO: 205828 - RNA, 1410 nt, Artificial Sequence; identical to SEQ ID NO: 199762
  derived and/or modified sequence opt5 from neuraminidase__InfluenzaA__AFN18522

SEQ ID NO: 205829 - RNA, 1410 nt, Artificial Sequence; identical to SEQ ID NO: 199762
  derived and/or modified sequence opt5 from neuraminidase__InfluenzaA__AFN18524

SEQ ID NO: 205830 - RNA, 1410 nt, Artificial Sequence; identical to SEQ ID NO: 205395
  derived and/or modified sequence opt5 from neuraminidase__InfluenzaA__AFN18530

SEQ ID NO: 205831 - RNA, 1410 nt, Artificial Sequence; identical to SEQ ID NO: 199762
  derived and/or modified sequence opt5 from neuraminidase__InfluenzaA__AFN18532

SEQ ID NO: 205832 - RNA, 1410 nt, Artificial Sequence; identical to SEQ ID NO: 199762
  derived and/or modified sequence opt5 from neuraminidase__InfluenzaA__AFN18538

SEQ ID NO: 205833 - RNA, 1410 nt, Artificial Sequence; identical to SEQ ID NO: 199762
  derived and/or modified sequence opt5 from neuraminidase__InfluenzaA__AFN18544

SEQ ID NO: 205834 - RNA, 1410 nt, Artificial Sequence; identical to SEQ ID NO: 199762
  derived and/or modified sequence opt5 from neuraminidase__InfluenzaA__AFN18546

SEQ ID NO: 205835 - RNA, 1410 nt, Artificial Sequence; identical to SEQ ID NO: 199762
  derived and/or modified sequence opt5 from neuraminidase__InfluenzaA__AFN18552

SEQ ID NO: 205836 - RNA, 1410 nt, Artificial Sequence; identical to SEQ ID NO: 199762
  derived and/or modified sequence opt5 from neuraminidase__InfluenzaA__AFN18558

SEQ ID NO: 205837 - RNA, 1410 nt, Artificial Sequence; identical to SEQ ID NO: 199762
  derived and/or modified sequence opt5 from neuraminidase__InfluenzaA__AFN18560

SEQ ID NO: 205838 - RNA, 1410 nt, Artificial Sequence; identical to SEQ ID NO: 199762
  derived and/or modified sequence opt5 from neuraminidase__InfluenzaA__AFN18562

SEQ ID NO: 205839 - RNA, 1410 nt, Artificial Sequence; identical to SEQ ID NO: 199762
  derived and/or modified sequence opt5 from neuraminidase__InfluenzaA__AFN18564

SEQ ID NO: 205840 - RNA, 1410 nt, Artificial Sequence; identical to SEQ ID NO: 199762
  derived and/or modified sequence opt5 from neuraminidase__InfluenzaA__AFN18566

SEQ ID NO: 205841 - RNA, 1410 nt, Artificial Sequence; identical to SEQ ID NO: 199762
  derived and/or modified sequence opt5 from neuraminidase__InfluenzaA__AFN18572

SEQ ID NO: 205842 - RNA, 1410 nt, Artificial Sequence; identical to SEQ ID NO: 199762
  derived and/or modified sequence opt5 from neuraminidase__InfluenzaA__AFN18582

SEQ ID NO: 205843 - RNA, 1410 nt, Artificial Sequence; identical to SEQ ID NO: 199762
  derived and/or modified sequence opt5 from neuraminidase__InfluenzaA__AFN18592

SEQ ID NO: 205844 - RNA, 1410 nt, Artificial Sequence; identical to SEQ ID NO: 205395
  derived and/or modified sequence opt5 from neuraminidase__InfluenzaA__AFN18602

SEQ ID NO: 205845 - RNA, 1410 nt, Artificial Sequence
  derived and/or modified sequence opt5 from neuraminidase__InfluenzaA__AFN18612
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucauuaagagcgucgagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 205846 - RNA, 1410 nt, Artificial Sequence; identical to SEQ ID NO: 199762
  derived and/or modified sequence opt5 from neuraminidase__InfluenzaA__AFN18618

SEQ ID NO: 205847 - RNA, 1410 nt, Artificial Sequence; identical to SEQ ID NO: 200588
  derived and/or modified sequence opt5 from neuraminidase__InfluenzaA__AFN18624

SEQ ID NO: 205848 - RNA, 1410 nt, Artificial Sequence
  derived and/or modified sequence opt5 from neuraminidase__InfluenzaA__AFN18630
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacugggcuguauccgcccuugcuucuggguggaacucauuagagggcggcccaaagagaacacgaucuggaccuccggaagcucuauuuccuuuuguggcguuaauagcgauacagugggguggucuuggcccgacggagcugagcugccuuucaccaucgauaaguga

SEQ ID NO: 205849 - RNA, 1410 nt, Artificial Sequence
  derived and/or modified sequence opt5 from neuraminidase__InfluenzaA__AFN18636
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucgugggcauuaaugaaugguccggguacucuggcagcuucguccaacaucccgagcuuacaggacuggauuguaucagaccuugcuucuggguggaacucauucggggccgcuccaaagagaacacgaucuggaccagcgggucuuccauuagcuuuuguggaguuaauucugacacagugggcugguccuggcccgauggggcugagcugcccuucaccaucgacaaguga

SEQ ID NO: 205850 - RNA, 1410 nt, Artificial Sequence; identical to SEQ ID NO: 199762
  derived and/or modified sequence opt5 from neuraminidase__InfluenzaA__AFN18646

SEQ ID NO: 205851 - RNA, 1410 nt, Artificial Sequence; identical to SEQ ID NO: 199762
  derived and/or modified sequence opt5 from neuraminidase__InfluenzaA__AFN18656

SEQ ID NO: 205852 - RNA, 1410 nt, Artificial Sequence
  derived and/or modified sequence opt5 from neuraminidase__InfluenzaA__AFN18666
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaucaucgacaaguga

SEQ ID NO: 205853 - RNA, 1410 nt, Artificial Sequence
  derived and/or modified sequence opt5 from neuraminidase__InfluenzaA__AFN18676
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccgaaaccgacaauaacuuuagcaucaagcaggacaucgugggaauuaaugagugguccggcuacucugggagcuucguccaacaucccgaacuuacaggccuggauuguaucagaccuugcuucuggguggagcucauucggggacgccccaaagagaacacgaucuggaccuccggcagcucuauuuccuuuugugggguuaauagcgacacagugggauggucuuggcccgauggcgcugaacugccuuucaccaucgacaaguga

SEQ ID NO: 205854 - RNA, 1410 nt, Artificial Sequence
  derived and/or modified sequence opt5 from neuraminidase__InfluenzaA__AFN18686
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuagcacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucacccugaugacggauggaccgucugacggccaggccagcuacaaaauuuuucgcaucgaaaagggcaaaaucgugaaguccgucgagaugaacgcucccaauuaucauuacgaagagugcucuuguuacccugauagcuccgagauuacaugcguuugcagagacaacuggcacgggagcaaucggcccugggugucuuucaaccagaaucuugaauaucagaucggauacauuuguuccggcaucuuuggggauaacccucgccccaaugacaaaaccggaagcugcggcccggugucuuccaacggggccaauggagucaagggcuucagcuuuaaguauggcaacgggguguggauuggaagaacaaaauccaucucuagccggaacggcuucgagaugauuugggauccuaauggguggaccggaaccgacaacaauuuuuccaucaagcaagacaucguuggcauuaacgaauggucuggguacagcggcuccuucgugcagcaucccgagcugacaggacucgauuguauccgcccuugcuucugggucgaacugauuagaggccggcccaaagagaauacgaucuggaccagcgggucuuccauuagcuuuuguggagugaacucugacacaguuggcugguccuggcccgauggggcugagcuuccuuucaccaucgacaaguga

SEQ ID NO: 205855 - RNA, 1410 nt, Artificial Sequence; identical to SEQ ID NO: 199762
  derived and/or modified sequence opt5 from neuraminidase__InfluenzaA__AFN18696

SEQ ID NO: 205856 - RNA, 1410 nt, Artificial Sequence; identical to SEQ ID NO: 202349
  derived and/or modified sequence opt5 from neuraminidase__InfluenzaA__AFN18706

SEQ ID NO: 205857 - RNA, 1410 nt, Artificial Sequence; identical to SEQ ID NO: 199762
  derived and/or modified sequence opt5 from neuraminidase__InfluenzaA__AFN18716

SEQ ID NO: 205858 - RNA, 1410 nt, Artificial Sequence; identical to SEQ ID NO: 199762
  derived and/or modified sequence opt5 from neuraminidase__InfluenzaA__AFN18727

SEQ ID NO: 205859 - RNA, 1410 nt, Artificial Sequence
  derived and/or modified sequence opt5 from neuraminidase__InfluenzaA__AFN18737
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagauggugugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 205860 - RNA, 1410 nt, Artificial Sequence; identical to SEQ ID NO: 199762
  derived and/or modified sequence opt5 from neuraminidase__InfluenzaA__AFN18743

SEQ ID NO: 205861 - RNA, 1410 nt, Artificial Sequence; identical to SEQ ID NO: 199762
  derived and/or modified sequence opt5 from neuraminidase__InfluenzaA__AFN18749

SEQ ID NO: 205862 - RNA, 1410 nt, Artificial Sequence; identical to SEQ ID NO: 199762
  derived and/or modified sequence opt5 from neuraminidase__InfluenzaA__AFN18759

SEQ ID NO: 205863 - RNA, 1410 nt, Artificial Sequence
  derived and/or modified sequence opt5 from neuraminidase__InfluenzaA__AFN18769
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucacccugaugacggauggaccgagcgacggccaggccucuuacaaaauuuuucgcaucgaaaagggcaaaaucgucaagagcguggagaugaaugcucccaacuaucauuacgaagagugcuccuguuacccugauucuaaugagauuacaugcguuugcagagacaacuggcacgggagcaaucggcccuggguguccuucaaccagaaucuugaauaucagaucggauacauuuguagcggcaucuuuggggauaacccucgccccaaugacaaaaccggaucuugcggcccgguguccagcaacggggccaacggagucaagggcuucucuuuuaaguauggcaaugggguguggauuggaagaacaaaauccaucagcucccggaacggcuucgagaugauuugggauccuaauggguggaccggaaccgacaacaauuuuucuaucaagcaagacaucguuggcauuaacgaauggagcggguacuccggcucuuucgugcagcaucccgagcugacaggacucgauuguauccgcccuugcuucugggucgaacugauuagaggccggcccaaagagaauacgaucuggaccagcggguccagcauuucuuuuuguggagugaacuccgacacaguuggcuggagcuggcccgauggggcugagcuuccuuucaccaucgacaaguga

SEQ ID NO: 205864 - RNA, 1410 nt, Artificial Sequence; identical to SEQ ID NO: 201664
  derived and/or modified sequence opt5 from neuraminidase__InfluenzaA__AFN18775

SEQ ID NO: 205865 - RNA, 1410 nt, Artificial Sequence; identical to SEQ ID NO: 199762
  derived and/or modified sequence opt5 from neuraminidase__InfluenzaA__AFN18777

SEQ ID NO: 205866 - RNA, 1410 nt, Artificial Sequence; identical to SEQ ID NO: 199762
  derived and/or modified sequence opt5 from neuraminidase__InfluenzaA__AFN18779

SEQ ID NO: 205867 - RNA, 1410 nt, Artificial Sequence
  derived and/or modified sequence opt5 from neuraminidase__InfluenzaA__AFN18785
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcauccgccaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 205868 - RNA, 1410 nt, Artificial Sequence
  derived and/or modified sequence opt5 from neuraminidase__InfluenzaA__AFN18791
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugagucuagcgaaauuacaugcgugugcagagauaauuggcacggguccaaccggcccugggugagcuucaaucagaaccuggaguaucagaucggauacauuuguucuggcaucuuuggggacaauccucgccccaacgauaaaaccggauccugcggcccggucagcucuaauggggccaacggagugaagggcuucuccuuuaaguauggcaacgggguuuggauuggaagaacaaaaagcaucuccucucggaauggcuucgaaaugauuugggacccuaacggguggaccggaaccgauaauaacuuuagcaucaagcaagacaucgugggcauuaaugagugguccggguacucuggcagcuucguccagcaucccgaacuuacaggacuggacuguauccgcccuugcuucuggguggagcucauuagaggccggcccaaagagaacacgaucuggaccuccgggagcucuauuuccuuuuguggaguuaauagcgauacagugggcuggucuuggcccgacggggcugaacugccuuucaccaucgauaaguga

SEQ ID NO: 205869 - RNA, 1410 nt, Artificial Sequence; identical to SEQ ID NO: 199762
  derived and/or modified sequence opt5 from neuraminidase__InfluenzaA__AFN18801

SEQ ID NO: 205870 - RNA, 1410 nt, Artificial Sequence; identical to SEQ ID NO: 202181
  derived and/or modified sequence opt5 from neuraminidase__InfluenzaA__AFN18811

SEQ ID NO: 205871 - RNA, 1410 nt, Artificial Sequence; identical to SEQ ID NO: 199762
  derived and/or modified sequence opt5 from neuraminidase__InfluenzaA__AFN18817

SEQ ID NO: 205872 - RNA, 1410 nt, Artificial Sequence; identical to SEQ ID NO: 199762
  derived and/or modified sequence opt5 from neuraminidase__InfluenzaA__AFN18819

SEQ ID NO: 205873 - RNA, 1410 nt, Artificial Sequence; identical to SEQ ID NO: 202754
  derived and/or modified sequence opt5 from neuraminidase__InfluenzaA__AFN18821

SEQ ID NO: 205874 - RNA, 1410 nt, Artificial Sequence; identical to SEQ ID NO: 199762
  derived and/or modified sequence opt5 from neuraminidase__InfluenzaA__AFN18823

SEQ ID NO: 205875 - RNA, 1410 nt, Artificial Sequence; identical to SEQ ID NO: 199762
  derived and/or modified sequence opt5 from neuraminidase__InfluenzaA__AFN18825

SEQ ID NO: 205876 - RNA, 1410 nt, Artificial Sequence; identical to SEQ ID NO: 199762
  derived and/or modified sequence opt5 from neuraminidase__InfluenzaA__AFN18827

SEQ ID NO: 205877 - RNA, 1410 nt, Artificial Sequence; identical to SEQ ID NO: 199762
  derived and/or modified sequence opt5 from neuraminidase__InfluenzaA__AFN18829

SEQ ID NO: 205878 - RNA, 1410 nt, Artificial Sequence; identical to SEQ ID NO: 199762
  derived and/or modified sequence opt5 from neuraminidase__InfluenzaA__AFN18831

SEQ ID NO: 205879 - RNA, 1410 nt, Artificial Sequence; identical to SEQ ID NO: 200899
  derived and/or modified sequence opt5 from neuraminidase__InfluenzaA__AFN18833

SEQ ID NO: 205880 - RNA, 1410 nt, Artificial Sequence; identical to SEQ ID NO: 200937
  derived and/or modified sequence opt5 from neuraminidase__InfluenzaA__AFN18835

SEQ ID NO: 205881 - RNA, 1410 nt, Artificial Sequence; identical to SEQ ID NO: 199762
  derived and/or modified sequence opt5 from neuraminidase__InfluenzaA__AFN18841

SEQ ID NO: 205882 - RNA, 1410 nt, Artificial Sequence
  derived and/or modified sequence opt5 from neuraminidase__InfluenzaA__AFN18851
augaaccccaaucagaagaucauuaccaucggcagcgugugcaugacaauugggauggccaaccugauccuccaaauuggaaauaugaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 205883 - RNA, 1410 nt, Artificial Sequence; identical to SEQ ID NO: 199762
  derived and/or modified sequence opt5 from neuraminidase__InfluenzaA__AFN18857

SEQ ID NO: 205884 - RNA, 1410 nt, Artificial Sequence
  derived and/or modified sequence opt5 from neuraminidase__InfluenzaA__AFN18859
augaaccccaaucagaagaucauuaccaucggcagcgugugcaugacaauugggcuggccaaccucauccugcaaauuggaaauaucaucuccauuuggaucucucacagcauucagcuuggcaaccagaaucagaucgagacguguaaccaauccgucauuaccuacgaaaauaacacauggguuaaucagaccuaugugaacaucucuaauacaaacuucgcugccgggcagagcguggucuccgugaaacuggcgggaaauucuagccucugcccuguuuccggcugggcuauuuacagcaaggacaacucuaucagaaucggguccaaaggagauguguuugucauucgggagccguucaucagcuguucuccccuggaaugccgcaccuuuuuccuuacacagggcgcccugcucaaugacaagcauuccaacggcaccauuaaagauagaagcccuuaucggacgcugaugucuugucccaucggggaggugccuucccccuacaacagccgcuuugaauccguugccuggucugcuagcgccugccacgacggaauuaauuggcugaccaucggcaucuccgggccugauaacggagcuguggccguccucaaguauaauggcauuaucacagacaccauuaagagcuggagaaacaauauccugcggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuugaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcugacaggacucgauuguauccgcccuugcuucuggguggaacugauuagaggccggcccaaagagaacacgaucuggaccuccgggagcucuauuuccuuuuguggaguuaauagcgacacagugggcuggucuuggcccgauggggcugagcuuccuuucaccaucgacaaguga

SEQ ID NO: 205885 - RNA, 1410 nt, Artificial Sequence
  derived and/or modified sequence opt5 from neuraminidase__InfluenzaA__AFN18861
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcuccguuagcggcugggcuauuuacucuaaggacaacuccaucagaaucgggagcaaaggagauguguuugucauucgggagccuuucaucucuuguuccccgcucgaaugccgcaccuuuuuccugacacagggcgcccuucugaaugacaagcauagcaacggcaccauuaaagauagaucucccuaucggacgcucauguccuguccuaucggggaggugcccagcccuuacaacucccgcuuugaaucuguugccuggagcgcuuccgccugccacgacggaauuaauuggcugaccaucggcaucagcgggcccgauaacggagcuguggccguccugaaguauaauggcauuaucacagacaccauuaagucuuggagaaacaauauccuccggacacaagaguccgagugugcgugcgugaacgggagcuguuucaccgugaugacggauggaccuucugacggccaggccagcuacaaaauuuuucgcaucgaaaagggcaaaaucgucaaguccguugagaugaaugcuccgaacuaucauuacgaagagugcucuuguuaccccgauagcuccgagauuacaugcgugugcagagacaauuggcacgggagcaaccggccuugggugucuuucaaucagaaccuggaauaucagaucggauacauuuguuccggcaucuuuggggauaauccccgcccuaacgacaaaaccggaagcugcggccccgucucuuccaauggggccaacggagugaagggcuucagcuuuaaguauggcaacgggguuuggauuggaagaacaaaauccaucucuagccggaauggcuucgagaugauuugggauccgaacggguggaccggaaccgacaauaacuuuuccaucaagcaagacaucgugggcauuaaugaauggucuggguacagcggcuccuucguccagcauccugagcuuacaggacuggauuguauccgccccugcuucuggguggaacucauuagaggccggccuaaagagaacacgaucuggaccagcgggucuuccauuagcuuuuguggaguuaauucugacacagugggcugguccuggcccgauggggcugagcugcccuucaccaucgacaaguga

SEQ ID NO: 205886 - RNA, 1410 nt, Artificial Sequence; identical to SEQ ID NO: 199762
  derived and/or modified sequence opt5 from neuraminidase__InfluenzaA__AFN18867

SEQ ID NO: 205887 - RNA, 1410 nt, Artificial Sequence; identical to SEQ ID NO: 201576
  derived and/or modified sequence opt5 from neuraminidase__InfluenzaA__AFN18877

SEQ ID NO: 205888 - RNA, 1410 nt, Artificial Sequence; identical to SEQ ID NO: 199762
  derived and/or modified sequence opt5 from neuraminidase__InfluenzaA__AFN18887

SEQ ID NO: 205889 - RNA, 1410 nt, Artificial Sequence; identical to SEQ ID NO: 200780
  derived and/or modified sequence opt5 from neuraminidase__InfluenzaA__AFN18893

SEQ ID NO: 205890 - RNA, 1410 nt, Artificial Sequence
  derived and/or modified sequence opt5 from neuraminidase__InfluenzaA__AFN18895
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucgugggcauuaaugaaugguccggguacucuggcagcuucguccaacaucccgagcuuacaggacuggauuguaucagaccuugcuucuggguggaacucauuaaaggccggcccaaggagaacacgaucuggaccuccgggagcucuauuuccuuuuguggaguuaauagcgacacagugggcuggucuuggcccgauggggcugagcugccuuucaccaucgacaaauga

SEQ ID NO: 205891 - RNA, 1410 nt, Artificial Sequence; identical to SEQ ID NO: 201664
  derived and/or modified sequence opt5 from neuraminidase__InfluenzaA__AFN18905

SEQ ID NO: 205892 - RNA, 1410 nt, Artificial Sequence; identical to SEQ ID NO: 201576
  derived and/or modified sequence opt5 from neuraminidase__InfluenzaA__AFN18913

SEQ ID NO: 205893 - RNA, 1410 nt, Artificial Sequence
  derived and/or modified sequence opt5 from neuraminidase__InfluenzaA__AFN18919
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggagaacggagugaagggcuucuccuuuaaguauggcaacgggguuuggauuggaagaacaaaaagcaucuccucucggaauggcuucgaaaugauuugggauccuaacggguggaccggaaccgacaauaacuuuagcaucaagcaagacaucgugggcauuaaugagugguccggguacucuggcagcuucguccagcaucccgaacuuacaggacuggauuguauccgcccuugcuucuggguggagcucauuagaggccggcccaaagagaacacgaucuggaccuccgggagcucuauuuccuuuuguggaguuaauagcgacacagugggcuggucuuggcccgauggggccgaacugccuuucaccaucgacaaguga

SEQ ID NO: 205894 - RNA, 1410 nt, Artificial Sequence
  derived and/or modified sequence opt5 from neuraminidase__InfluenzaA__AFN18929
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucacccugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuugaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcugacaggacucgauuguauccgcccuugcuucugggucgaacugauuagaggccggcccaaagagaacacgaucuggaccuccgggagcucuauuuccuuuuguggagugaauagcgacacaguuggcuggucuugguccgauggggcugagcuucccuucaccaucgacaaguga

SEQ ID NO: 205895 - RNA, 1410 nt, Artificial Sequence; identical to SEQ ID NO: 199762
  derived and/or modified sequence opt5 from neuraminidase__InfluenzaA__AFN18939

SEQ ID NO: 205896 - RNA, 1410 nt, Artificial Sequence; identical to SEQ ID NO: 199762
  derived and/or modified sequence opt5 from neuraminidase__InfluenzaA__AFN18953

SEQ ID NO: 205897 - RNA, 1410 nt, Artificial Sequence; identical to SEQ ID NO: 199762
  derived and/or modified sequence opt5 from neuraminidase__InfluenzaA__AFN18959

SEQ ID NO: 205898 - RNA, 1410 nt, Artificial Sequence; identical to SEQ ID NO: 199762
  derived and/or modified sequence opt5 from neuraminidase__InfluenzaA__AFN18965

SEQ ID NO: 205899 - RNA, 1410 nt, Artificial Sequence; identical to SEQ ID NO: 203832
  derived and/or modified sequence opt5 from neuraminidase__InfluenzaA__AFN18975

SEQ ID NO: 205900 - RNA, 1410 nt, Artificial Sequence; identical to SEQ ID NO: 199762
  derived and/or modified sequence opt5 from neuraminidase__InfluenzaA__AFN18981

SEQ ID NO: 205901 - RNA, 1410 nt, Artificial Sequence
  derived and/or modified sequence opt5 from neuraminidase__InfluenzaA__AFN18983
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcuuccaacuaucauuacgaagagugcucuuguuaccccgauagcuccgagauuacaugcgugugcagagacaauuggcacgggagcaaccggccuugggugucuuucaaucagaaccuggaauaucagaucggauacauuuguuccggcaucuuuggggauaauccccgcccuaacgacaaaaccggaagcugcggccccgucucuuccaauggggccaacggagugaagggcuucagcuuuaaguauggcaacgggguuuggauuggaagaacaaaauccaucucuagccggaauggcuucgagaugauuugggauccgaacggguggaccggaaccgacaauaacuuuuccaucaagcaagacaucgugggcauuaaugaauggucuggguacagcggcuccuucguccagcauccugagcuuacaggacuggauuguauccgccccugcuucuggguggaacucauuagaggccggccuaaagagaacacgaucuggaccagcgggucuauuaucuccuuuuguggaguuaauagcgacacagugggcuggucuuggcccgauggggcugagcugcccuucaccaucgacaaguga

SEQ ID NO: 205902 - RNA, 1410 nt, Artificial Sequence; identical to SEQ ID NO: 199762
  derived and/or modified sequence opt5 from neuraminidase__InfluenzaA__AFN18985

SEQ ID NO: 205903 - RNA, 1410 nt, Artificial Sequence
  derived and/or modified sequence opt5 from neuraminidase__InfluenzaA__AFN18987
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccauugacaaaaccggauccugcggcccggucagcucuaacggggccaauggagugaagggcuucuccuuuaaguauggcaacgggguuuggaucggaagaacaaaaagcauuuccucucggaacggcuucgagaugaucugggauccuaauggguggaccggaaccgacaacaauuuuagcaucaagcaagacauugugggcaucaacgaaugguccggguacucuggcagcuucguccagcaucccgagcuuacaggacuggauuguauucgcccuugcuucuggguggaacucaucagaggccggcccaaagagaauacgauuuggaccuccgggagcucuaucuccuuuuguggaguuaacagcgacacagugggcuggucuuggcccgauggggcugagcugccuuucaccaucgacaaguga

SEQ ID NO: 205904 - RNA, 1410 nt, Artificial Sequence; identical to SEQ ID NO: 199762
  derived and/or modified sequence opt5 from neuraminidase__InfluenzaA__AFN18989

SEQ ID NO: 205905 - RNA, 1410 nt, Artificial Sequence; identical to SEQ ID NO: 199762
  derived and/or modified sequence opt5 from neuraminidase__InfluenzaA__AFN18995

SEQ ID NO: 205906 - RNA, 1410 nt, Artificial Sequence; identical to SEQ ID NO: 205884
  derived and/or modified sequence opt5 from neuraminidase__InfluenzaA__AFN19001

SEQ ID NO: 205907 - RNA, 1410 nt, Artificial Sequence; identical to SEQ ID NO: 199762
  derived and/or modified sequence opt5 from neuraminidase__InfluenzaA__AFN19007

SEQ ID NO: 205908 - RNA, 1410 nt, Artificial Sequence; identical to SEQ ID NO: 199762
  derived and/or modified sequence opt5 from neuraminidase__InfluenzaA__AFN19024

SEQ ID NO: 205909 - RNA, 1410 nt, Artificial Sequence
  derived and/or modified sequence opt5 from neuraminidase__InfluenzaA__AFN19025
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaaaauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaauggagugaagggcuucuccuuuaaauauggcaacgggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 205910 - RNA, 1410 nt, Artificial Sequence; identical to SEQ ID NO: 199762
  derived and/or modified sequence opt5 from neuraminidase__InfluenzaA__AFN19027

SEQ ID NO: 205911 - RNA, 1410 nt, Artificial Sequence; identical to SEQ ID NO: 199762
  derived and/or modified sequence opt5 from neuraminidase__InfluenzaA__AFN19032

SEQ ID NO: 205912 - RNA, 1410 nt, Artificial Sequence; identical to SEQ ID NO: 199762
  derived and/or modified sequence opt5 from neuraminidase__InfluenzaA__AFN19038

SEQ ID NO: 205913 - RNA, 1410 nt, Artificial Sequence; identical to SEQ ID NO: 205395
  derived and/or modified sequence opt5 from neuraminidase__InfluenzaA__AFN19049

SEQ ID NO: 205914 - RNA, 1410 nt, Artificial Sequence; identical to SEQ ID NO: 199762
  derived and/or modified sequence opt5 from neuraminidase__InfluenzaA__AFN19055

SEQ ID NO: 205915 - RNA, 1410 nt, Artificial Sequence; identical to SEQ ID NO: 199762
  derived and/or modified sequence opt5 from neuraminidase__InfluenzaA__AFN19065

SEQ ID NO: 205916 - RNA, 1410 nt, Artificial Sequence; identical to SEQ ID NO: 199762
  derived and/or modified sequence opt5 from neuraminidase__InfluenzaA__AFN19071

SEQ ID NO: 205917 - RNA, 1410 nt, Artificial Sequence; identical to SEQ ID NO: 199762
  derived and/or modified sequence opt5 from neuraminidase__InfluenzaA__AFN19077

SEQ ID NO: 205918 - RNA, 1410 nt, Artificial Sequence; identical to SEQ ID NO: 199762
  derived and/or modified sequence opt5 from neuraminidase__InfluenzaA__AFN19083

SEQ ID NO: 205919 - RNA, 1410 nt, Artificial Sequence; identical to SEQ ID NO: 199762
  derived and/or modified sequence opt5 from neuraminidase__InfluenzaA__AFN19089

SEQ ID NO: 205920 - RNA, 1410 nt, Artificial Sequence; identical to SEQ ID NO: 199762
  derived and/or modified sequence opt5 from neuraminidase__InfluenzaA__AFN19099

SEQ ID NO: 205921 - RNA, 1410 nt, Artificial Sequence; identical to SEQ ID NO: 199762
  derived and/or modified sequence opt5 from neuraminidase__InfluenzaA__AFN19105

SEQ ID NO: 205922 - RNA, 1410 nt, Artificial Sequence; identical to SEQ ID NO: 199762
  derived and/or modified sequence opt5 from neuraminidase__InfluenzaA__AFN19114

SEQ ID NO: 205923 - RNA, 1410 nt, Artificial Sequence; identical to SEQ ID NO: 199762
  derived and/or modified sequence opt5 from neuraminidase__InfluenzaA__AFN19126

SEQ ID NO: 205924 - RNA, 1410 nt, Artificial Sequence; identical to SEQ ID NO: 199762
  derived and/or modified sequence opt5 from neuraminidase__InfluenzaA__AFN19136

SEQ ID NO: 205925 - RNA, 1410 nt, Artificial Sequence; identical to SEQ ID NO: 199762
  derived and/or modified sequence opt5 from neuraminidase__InfluenzaA__AFN19146

SEQ ID NO: 205926 - RNA, 1410 nt, Artificial Sequence; identical to SEQ ID NO: 199762
  derived and/or modified sequence opt5 from neuraminidase__InfluenzaA__AFN19156

SEQ ID NO: 205927 - RNA, 1410 nt, Artificial Sequence; identical to SEQ ID NO: 199762
  derived and/or modified sequence opt5 from neuraminidase__InfluenzaA__AFN19166

SEQ ID NO: 205928 - RNA, 1410 nt, Artificial Sequence; identical to SEQ ID NO: 199762
  derived and/or modified sequence opt5 from neuraminidase__InfluenzaA__AFN19186

SEQ ID NO: 205929 - RNA, 1410 nt, Artificial Sequence; identical to SEQ ID NO: 205395
  derived and/or modified sequence opt5 from neuraminidase__InfluenzaA__AFN19196

SEQ ID NO: 205930 - RNA, 1410 nt, Artificial Sequence; identical to SEQ ID NO: 199762
  derived and/or modified sequence opt5 from neuraminidase__InfluenzaA__AFN19205

SEQ ID NO: 205931 - RNA, 1410 nt, Artificial Sequence; identical to SEQ ID NO: 199762
  derived and/or modified sequence opt5 from neuraminidase__InfluenzaA__AFN19215

SEQ ID NO: 205932 - RNA, 1410 nt, Artificial Sequence; identical to SEQ ID NO: 199762
  derived and/or modified sequence opt5 from neuraminidase__InfluenzaA__AFN19225

SEQ ID NO: 205933 - RNA, 1410 nt, Artificial Sequence; identical to SEQ ID NO: 199762
  derived and/or modified sequence opt5 from neuraminidase__InfluenzaA__AFN19235

SEQ ID NO: 205934 - RNA, 1410 nt, Artificial Sequence; identical to SEQ ID NO: 199762
  derived and/or modified sequence opt5 from neuraminidase__InfluenzaA__AFN19245

SEQ ID NO: 205935 - RNA, 1410 nt, Artificial Sequence; identical to SEQ ID NO: 199762
  derived and/or modified sequence opt5 from neuraminidase__InfluenzaA__AFN19251

SEQ ID NO: 205936 - RNA, 1410 nt, Artificial Sequence; identical to SEQ ID NO: 199762
  derived and/or modified sequence opt5 from neuraminidase__InfluenzaA__AFN19261

SEQ ID NO: 205937 - RNA, 1410 nt, Artificial Sequence; identical to SEQ ID NO: 205395
  derived and/or modified sequence opt5 from neuraminidase__InfluenzaA__AFN19271

SEQ ID NO: 205938 - RNA, 1410 nt, Artificial Sequence; identical to SEQ ID NO: 201493
  derived and/or modified sequence opt5 from neuraminidase__InfluenzaA__AFN19281

SEQ ID NO: 205939 - RNA, 1410 nt, Artificial Sequence
  derived and/or modified sequence opt5 from neuraminidase__InfluenzaA__AFN19287
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucuguccgacaagcauagcaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 205940 - RNA, 1410 nt, Artificial Sequence; identical to SEQ ID NO: 199762
  derived and/or modified sequence opt5 from neuraminidase__InfluenzaA__AFN19297

SEQ ID NO: 205941 - RNA, 1410 nt, Artificial Sequence; identical to SEQ ID NO: 199762
  derived and/or modified sequence opt5 from neuraminidase__InfluenzaA__AFN19307

SEQ ID NO: 205942 - RNA, 1410 nt, Artificial Sequence; identical to SEQ ID NO: 199762
  derived and/or modified sequence opt5 from neuraminidase__InfluenzaA__AFN19317

SEQ ID NO: 205943 - RNA, 1410 nt, Artificial Sequence; identical to SEQ ID NO: 205395
  derived and/or modified sequence opt5 from neuraminidase__InfluenzaA__AFN19327

SEQ ID NO: 205944 - RNA, 1410 nt, Artificial Sequence; identical to SEQ ID NO: 199762
  derived and/or modified sequence opt5 from neuraminidase__InfluenzaA__AFN19346

SEQ ID NO: 205945 - RNA, 1410 nt, Artificial Sequence
  derived and/or modified sequence opt5 from neuraminidase__InfluenzaA__AFN19352
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauucuguuuaucgaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcggccauugccuugacccuaacaaugaggaagggggacacggcgugaaagggugggccuucgaugacggaaacgauguuuggaugggccgcacgauuaaugagacauccagacugggguaugagaccuuuaaggugaucgaaggauggagcaaccccaaaucuaagcuccagaucaaucggcaggucauuguggaccgcuccgauagaagcggcuacucuggcaucuucuccgucgaggggaaaagcuguauuaaccggugcuuuuauguggaacugaucagaggacgcaaggaggaaaccgagguucuguggacauccaauucuauuguggucuucuguggcaccagcgggacauacggaacgggcuccuggccugacggggcugaucucaaccugaugcccaucuga

SEQ ID NO: 205946 - RNA, 1410 nt, Artificial Sequence
  derived and/or modified sequence opt5 from neuraminidase__InfluenzaA__AFN19354
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggacauccaauucuaucguggucuucuguggcaccagcgggacauacggaacgggcuccuggccugacggggcugaucucaaccugaugcccauuuga

SEQ ID NO: 205947 - RNA, 1410 nt, Artificial Sequence; identical to SEQ ID NO: 205946
  derived and/or modified sequence opt5 from neuraminidase__InfluenzaA__AFN19356

SEQ ID NO: 205948 - RNA, 1410 nt, Artificial Sequence; identical to SEQ ID NO: 205946
  derived and/or modified sequence opt5 from neuraminidase__InfluenzaA__AFN19358

SEQ ID NO: 205949 - RNA, 1410 nt, Artificial Sequence; identical to SEQ ID NO: 205946
  derived and/or modified sequence opt5 from neuraminidase__InfluenzaA__AFN19360

SEQ ID NO: 205950 - RNA, 1410 nt, Artificial Sequence
  derived and/or modified sequence opt5 from neuraminidase__InfluenzaA__AFN19362
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaacgguguaucaacagaugcuuuuauguggaacugauucgcggacggaaggaggaaaccgagguucuguggacaagcaauuccaucguggucuucuguggcaccucugggacauacggaacgggcagcuggccugacggggcugaucucaaccugaugcccauuuga

SEQ ID NO: 205951 - RNA, 1410 nt, Artificial Sequence; identical to SEQ ID NO: 205946
  derived and/or modified sequence opt5 from neuraminidase__InfluenzaA__AFN19364

SEQ ID NO: 205952 - RNA, 1410 nt, Artificial Sequence; identical to SEQ ID NO: 202542
  derived and/or modified sequence opt5 from neuraminidase__InfluenzaA__AFN19366

SEQ ID NO: 205953 - RNA, 1410 nt, Artificial Sequence; identical to SEQ ID NO: 205946
  derived and/or modified sequence opt5 from neuraminidase__InfluenzaA__AFN19370

SEQ ID NO: 205954 - RNA, 1410 nt, Artificial Sequence
  derived and/or modified sequence opt5 from neuraminidase__InfluenzaA__AFN19374
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucaaggagggaaagauuguucauaccuccacacucucuggcagcgcgcaacacguggaagagugcuccugcuaucccagauacccuggggugcggugugucugccgcgauaacuggaaaggaagcaauagacccaucguggacauuaacaucaaggaucacucuauuguuuccagcuacguguguucuggccuggucggcgacaccccgcggaaaacggacagcuccucuagcucccauugccuugauccuaauaacgaagaagggggacacggcgugaaggggugggccuucgacgauggaaaugacguuuggaugggccgcacaaucaacgagaccagcagacugggguaugagaccuuuaaagugaucgagggauggucuaaucccaaguccaaacuccagauuaaccggcaggucaucguggaucgcggcgacagaagcggcuacucugggauuuucuccgucgaaggaaagagcuguaucaaucggugcuuuuauguggagcugauuagaggccgcaaggaagagacagaaguucuguggaccuccaacucuaucguggucuucugugggacaagcggaacguacggcaccggguccuggccugauggcgcugaccucaaucugaugcccauuuga

SEQ ID NO: 205955 - RNA, 1410 nt, Artificial Sequence; identical to SEQ ID NO: 205946
  derived and/or modified sequence opt5 from neuraminidase__InfluenzaA__AFN19376

SEQ ID NO: 205956 - RNA, 1410 nt, Artificial Sequence; identical to SEQ ID NO: 205946
  derived and/or modified sequence opt5 from neuraminidase__InfluenzaA__AFN19378

SEQ ID NO: 205957 - RNA, 1410 nt, Artificial Sequence
  derived and/or modified sequence opt5 from neuraminidase__InfluenzaA__AFN19380
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccuccgaguaccggaauuggucuaagccucagugugacauuaccggguucgcucccuuuagcaaagauaacuccauccgccucucugccggaggcgacaucugggugacaagagagccuuaugucagcugcgauccggacaaguguuaccaauucgcgcuggggcagggaaccacacuuaauaacgugcauuccaauaacaccguucgggaucgcacgcccuauagaacacugcucaugaaugaacugggcgugccuuuucaccuggggaccaagcaggucugcauugcuuggucuagcuccagcugucaugacggaaaagccuggcuccacgugugcaucacaggcgaugacaagaacgccaccgcuucuuucauuuacaauggccggcugguugauuccguggucagcuggucuaaagagauccuucgcacccaggaauccgagugugugugcauuaacgggacauguacgguggucaugaccgacggaagcgccuccggcaaggcugauacaaaaauccuguuuaucgaggaagggaagauuguucauaccucuacacucagcggauccgcccaacacguggaggaaugcagcugcuaucccagauacccuggcgugcggugugucugccgcgacaacuggaaggggucuaauagacccaucguggauauuaacaucaaagaccacuccauuguuagcucuuacguguguagcggacuggucggcgacaccccgcggaagaaugauuccucuagcuccagccauugccuugacccuaacaaugaggaaggcgggcacggagugaaaggcugggcguucgaugacgggaacgauguuuggaugggacgcacgaucaaugagacaucuagacugggcuaugagaccuuuaaggugaucgaagggugguccaaccccaaaagcaagcuccagauuaaucggcaggucaucguggaccgcggagauagaucuggcuacuccggcauuuucagcgucgaggggaaauccuguaucaaccggugcuuuuauguggaacugauuagaggacgcaaggaggaaaccgagguucuguggacaucuaauagcaucguggucuucuguggcaccuccgggacauacggaacgggcucuuggccugacggggccgaucucaaccugaugcccauuuga

SEQ ID NO: 205958 - RNA, 1410 nt, Artificial Sequence; identical to SEQ ID NO: 205954
  derived and/or modified sequence opt5 from neuraminidase__InfluenzaA__AFN19382

SEQ ID NO: 205959 - RNA, 1410 nt, Artificial Sequence; identical to SEQ ID NO: 205946
  derived and/or modified sequence opt5 from neuraminidase__InfluenzaA__AFN19384

SEQ ID NO: 205960 - RNA, 1410 nt, Artificial Sequence
  derived and/or modified sequence opt5 from neuraminidase__InfluenzaA__AFN19386
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcagaucauugucgaccgcggagauagaagcggcuacucuggcaucuucuccguggaggggaaaagcuguauuaaccggugcuuuuaugucgaacugaucagaggacgcaaggaggaaaccgaggugcuguggacauccaauucuauuguuguguucuguggcaccagcgggacauacggaacgggcuccuggccugacggggcugaucucaaccugaugcccaucuga

SEQ ID NO: 205961 - RNA, 1410 nt, Artificial Sequence; identical to SEQ ID NO: 205946
  derived and/or modified sequence opt5 from neuraminidase__InfluenzaA__AFN19388

SEQ ID NO: 205962 - RNA, 1410 nt, Artificial Sequence; identical to SEQ ID NO: 205946
  derived and/or modified sequence opt5 from neuraminidase__InfluenzaA__AFN19390

SEQ ID NO: 205963 - RNA, 1410 nt, Artificial Sequence
  derived and/or modified sequence opt5 from neuraminidase__InfluenzaA__AFN19392
augaaccccaaucagaagaucauuaccaucggcagcgugucccugacaauuucuacgaucugcuucuuuaugcaaauugccguccucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcaucgccugguccucuagcuccugucaugacggaaaggccuggcuccacguuugcauuacaggcgaugacaagaacgcuaccgccagcuucaucuacaauggccggcugguggauucugucguguccuggagcaaagagauucuucgcacccaggaaucugagugugugugcaucaacgggacauguacggucguuaugaccgacggauccgcuagcggcaaggccgauacaaaaauucuguuuaucgaggaagggaagaucgugcauaccuccacacucucuggaagcgcgcaacacguggaggaaugcuccugcuaucccagauacccuggcguccggugugugugccgcgacaacuggaaggggagcaauagacccauuguugauaucaacauuaaagaccacucuaucguguccagcuacgucuguucuggacuggugggcgacaccccgcggaagaaugauagcuccucuagcucccauugccuugacccuaacaaugaggaaggcgggcacggaguuaaaggcugggccuucgaugacgggaacgauguguggaugggacgcacgauuaaugagacaagcagacugggcuaugagaccuuuaaggucaucgaaggguggucuaaccccaaauccaagcuccagaucaaucgccaggugauugucgaccggggagauagaagcggcuacucuggcaucuucuccguggaggggaaaagcuguauuaaccggugcuuuuauguugaacugaucagaggacgcaaggaggaaaccgaggugcuguggacauccaauucuauugucguguucuguggcaccagcgggacauacggaacgggcuccuggccugacggggcugaucucaaccugaugcccaucuga

SEQ ID NO: 205964 - RNA, 1410 nt, Artificial Sequence; identical to SEQ ID NO: 204811
  derived and/or modified sequence opt5 from neuraminidase__InfluenzaA__AFN19394

SEQ ID NO: 205965 - RNA, 1410 nt, Artificial Sequence
  derived and/or modified sequence opt5 from neuraminidase__InfluenzaA__AFN19396
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacaugugcuguggucaugacggauggauccgccagcggcaaggcggacaccaaaauccucuuuaucgaggaggggaagauuguucauacauccacccugucuggaagcgcccaacacguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacaccccggaagaaugacagcuccucuagcucccauugccuggauccgaacaaugaagagggcgggcacggagugaaaggcugggcuuucgacgaugggaacgacguuuggaugggacgcaccaucaaugaaacgagcagacucggcuaugagacauuuaaggugaucgagggguggucuaacccuaaauccaagcugcagauuaaucggcaggucaucguggaucgcggaaacagaagcggcuacucuggcauuuucuccgucgaagggaaaaauuguaucaaccggugcuuuuauguggagcugauuagaggacgcaaggaagagaccgaaguucucuggaccagcaauuccaucguggucuucuguggcacaucugggaccuacggaacaggcagcuggcccgacggggccgaucugaaccuuaugccuauuuga

SEQ ID NO: 205966 - RNA, 1410 nt, Artificial Sequence
  derived and/or modified sequence opt5 from neuraminidase__InfluenzaA__AFN19398
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccagcagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggagagggagcaaucggcccaucguggauauuaacaucaaggaccacucuauuguuuccagcuacguguguucuggacuggucggcgacaccccgcgcaaaaaugauagcuccucuagcucccauugccuugacccuaacaaugaggaaggcgggcacggagugaagggcugggccuucgaugacgggaacgauguuuggaugggaagaacgaucaaugagacaagccggcugggcuaugagaccuuuaaagugaucgaaggguggucuaaccccaaguccaaacuccagauuaaucgccaggucaucguggacagaggagaucggagcggcuacucuggcauuuucuccgucgaggggaagucuuguaucaacagaugcuuuuauguggaacugauucgcggacggaaagaggaaaccgagguucuguggacauccaauucuaucguggucuucuguggcaccagcgggacauacggaacgggcuccuggccugacggggcugaucucaaccugaugcccauuuga

SEQ ID NO: 205967 - RNA, 1410 nt, Artificial Sequence
  derived and/or modified sequence opt5 from neuraminidase__InfluenzaA__AFN19400
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccuccgaguaccggaauuggucuaagccucagugugacauuaccggguucgcucccuuuagcaaagauaacuccauccgccucucugacggaggcgauaucugggugacaagagagccuuaugucagcugcgacccggauaaguguuaccaauucgcccuggggcagggaaccacacuuaauaacgugcauuccaauaacaccguucgggaccgcacgcccuauagaacacugcucaugaaugaacugggcgugccuuuucaccuggggaccaagcaggucugcauugcguggucuagcuccagcugucaugauggaaaggcuuggcuccacgugugcaucacaggcgacgauaaaaacgccaccgccucuuucauuuacaauggccggcugguugacuccguggucagcuggucuaaagagauccuucgcacccaggaauccgagugugugugcauuaacgggacauguacgguggucaugaccgauggaagcgcuuccggcaaggccgacacaaaaauccuguuuaucgaggaagggaagauuguucauaccucuacacucagcggauccgcucaacacguggaggaaugcagcugcuaucccagauacccuggcgugcggugugucugccgcgauaacuggaaggggucuaauagacccaucguggacauuaacaucaaagaccacuccauuguuagcucuuacguguguagcggacuggucggcgauaccccgcggaagaaugacuccucuagcuccagccauugccuugauccuaacaaugaggaaggcgggcacggagugaaaggcugggccuucgacgaugggaacgacguuuggaugggacgcacgaucaaugagacaucuagacugggcuaugagaccuuuaaggugaucgaagggugguccaaccccaaaagcaagcuccagauuaaucggcaggucaucguggaucgcggagacagaucuggcuacuccggcauuuucagcgucgaggggaaauccuguaucaaccggugcuuuuauguggaacugauuagaggacgcaaggaggaaaccgagguucuguggacaucuaauagcaucguggucuucuguggcaccuccgggacauacggaacgggcucuuggccugauggggcggaccucaaccugaugcccauuuga

SEQ ID NO: 205968 - RNA, 1410 nt, Artificial Sequence; identical to SEQ ID NO: 205946
  derived and/or modified sequence opt5 from neuraminidase__InfluenzaA__AFN19402

SEQ ID NO: 205969 - RNA, 1410 nt, Artificial Sequence; identical to SEQ ID NO: 205946
  derived and/or modified sequence opt5 from neuraminidase__InfluenzaA__AFN19404

SEQ ID NO: 205970 - RNA, 1410 nt, Artificial Sequence; identical to SEQ ID NO: 205946
  derived and/or modified sequence opt5 from neuraminidase__InfluenzaA__AFN19406

SEQ ID NO: 205971 - RNA, 1410 nt, Artificial Sequence; identical to SEQ ID NO: 205946
  derived and/or modified sequence opt5 from neuraminidase__InfluenzaA__AFN19410

SEQ ID NO: 205972 - RNA, 1410 nt, Artificial Sequence; identical to SEQ ID NO: 205946
  derived and/or modified sequence opt5 from neuraminidase__InfluenzaA__AFN19412

SEQ ID NO: 205973 - RNA, 1410 nt, Artificial Sequence; identical to SEQ ID NO: 205946
  derived and/or modified sequence opt5 from neuraminidase__InfluenzaA__AFN19414

SEQ ID NO: 205974 - RNA, 1410 nt, Artificial Sequence; identical to SEQ ID NO: 205946
  derived and/or modified sequence opt5 from neuraminidase__InfluenzaA__AFN19416

SEQ ID NO: 205975 - RNA, 1410 nt, Artificial Sequence
  derived and/or modified sequence opt5 from neuraminidase__InfluenzaA__AFN19418
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccagcagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcagagccgauacaaagauccuguuuaucgaggaagggaaaauuguucauaccuccacacucucuggaagcgcgcaacacguggaggaaugcuccugcuauccccgguacccuggcgugcgcugugucugcagagacaacuggaaggggagcaaucggcccaucguggauauuaacaucaaggaccacucuauuguuuccagcuacguguguucuggacuggucggcgacaccccgcgcaaaaaugauagcuccucuagcucccauugccuugacccuaacaaugaggaaggcgggcacggagugaagggcugggccuucgaugacgggaacgauguuuggaugggaagaacgaucaaugagacaagccggcugggcuaugagaccuuuaaagugaucgaaggguggucuaaccccaaguccaaacuccagauuaaucgccaggucaucguggacagaggagaucggagcggcuacucuggcauuuucuccgucgaggggaagucuuguaucaacagaugcuuuuauguggaacugauucgcggacggaaagaggaaaccgagguucuguggacauccaauucuaucguggucuucuguggcaccagcgggacauacggaacgggcuccuggccugacggggcugaucucaaccugaugcccauuuga

SEQ ID NO: 205976 - RNA, 1410 nt, Artificial Sequence
  derived and/or modified sequence opt5 from neuraminidase__InfluenzaA__AFN19420
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauucuguuuaucgaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgauuaaugagacaagcagacugggcuaugagaccuuuaaggugaucgaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaaccgagguucuguggacauccaauucuauuguggucuucuguggcaccagcgggacauacggaacgggcuccuggccugacggggcugaucucaaccugaugcccaucuga

SEQ ID NO: 205977 - RNA, 1410 nt, Artificial Sequence
  derived and/or modified sequence opt5 from neuraminidase__InfluenzaA__AFN19422
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcaacgacaagaaugcuaccgccagcuucauuuacaacgggcggcugguugauucuguggucuccuggagcaaagaggugcuucgcacccaggaaucugagugugugugcaucaacggaacauguacggucguuaugaccgacggcuccgcuagcgggaaggccgauacaaaaauucuguuuaucgaggaaggaaagaucgugcauaccuccacacucucuggcagcgcgcaacacguggaggaaugcuccugcuaucccagauacccugggguccggugugugugccgcgacaauuggaagggaagcaacagacccauuguugauaucaauauuaaagaccacucuaucguguccagcuacgucuguucuggccuggugggcgauaccccgcggaagaacgacagcuccucuagcucccauugccuugacccuaauaacgaggaagggggacacggcguuaaagggugggccuucgaugacggaaaugauguguggaugggccgcacgauuaacgagacaagcagacugggguaugagaccuuuaaggucaucgaaggauggucuaaucccaaauccaagcuccagaucaaccgccaggugauugucgaccggggcgauagaagcggcuacucugggaucuucuccguggagggaaaaagcuguauuaaucggugcuuuuauguugaacugaucagaggccgcaaggaggaaaccgaggugcuguggacauccaacucuauugucguguucugugggaccagcggaacauacggcacgggguccuggccugacggcgcugaucucaaucugaugcccaucuga

SEQ ID NO: 205978 - RNA, 1410 nt, Artificial Sequence
  derived and/or modified sequence opt5 from neuraminidase__InfluenzaA__AFN19426
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccagcagcuccugucaugacggaaaagccuggcuccacgugugcaucacaggcgaugacgagaacgcuaccgccagcuucauuuacaauggccggcugguugauucuguggucuccuggagcaaggaaauccuucgcacccaggagucugagugugugugcauuaacgggacauguacgguggucaugaccgacggauccgcuagcggcaaagccgauacaaagauccuguuuaucgaagaggggaaaauuguucauaccuccacacucucuggaagcgcgcaacacguggaagagugcuccugcuaucccagauacccuggcgugcggugugucugccgcgacaacuggaaggggagcaauagacccaucguggauauuaacaucaaggaccacucuauuguuuccagcuacguguguucuggacuggucggcgacaccccgcggaaaaaugauagcuccucuagcucccauugccuugacccuaacaaugaagagggcgggcacggagugaagggcugggccuucgaugacgggaacgauguuuggaugggacgcacgaucaaugagacaagcagacugggcuaugaaaccuuuaaagugaucgagggguggucuaaccccaaguccaaacuccagauuaaucggcaggucaucguggaccgcggagauagaagcggcuacucuggcauuuucuccgucgaagggaagucuuguaucaaccggugcuuuuauguggagcugauuagaggacgcaaagaagagaccgagguucuguggacauccaauucuaucguggucuucuguggcaccagcgggacauacggaacgggcuccuggccugacggggcugaucucaaccugaugcccauuuga

SEQ ID NO: 205979 - RNA, 1410 nt, Artificial Sequence; identical to SEQ ID NO: 205946
  derived and/or modified sequence opt5 from neuraminidase__InfluenzaA__AFN19428

SEQ ID NO: 205980 - RNA, 1410 nt, Artificial Sequence
  derived and/or modified sequence opt5 from neuraminidase__InfluenzaA__AFN19430
augaaccccaaucagaagaucauuaccaucggcagcgugucccugacaauuucuacgaucugcuucuuuaugcaaauugccauccucaucauuaccgucacacugcacuucaaacaguacgaguuuaacagcccuccgaauaaccagguuaugcuuugugaacccaccaucauugagagaaauaugacagaaaucguguaucugaccaacacaaccauugagaaggaaaucugcccuaaacccgcugaguaccggaauugguccaagccucagugugacauuacgggguucgcccccuuuucuaaagauaacagcauccgccucuccgcgggaggcgacaucugggugaccagagagccuuaugucucuugcgauccggacaaguguuaccaauucgcucuggggcagggaacaacccuuaauaacgugcauagcaauaacacaguucgggaucgcacccccuauagaacgcugcucaugaaugaacugggcgugccuuuucaccuggggacaaagcaggucugcauugccugguccucuagcuccugucaugacggaaaagccuggcuccacgugugcaucaccggcgaugacaagaacgcuacagccagcuucauuuacaauggccggcugguugauucuguggucuccuggagcaaagagauccuucgcacccaggaaucugagugugugugcauuaacgggaccuguacaguggucaugacggacggauccgcuagcggcaaggccgauaccaaaauccuguuuaucgaggaagggaagauuguucauacauccacccucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacacaccgcggaagaaugauagcuccucuagcucccauugccuugacccuaacaaugaggaaggcgggcacggagugaaaggcugggccuucgaugacgggaacgauguuuggaugggacgcaccaucaaugagacgagcagacugggcuaugagacauuuaaggugaucgaaggguggucuaaccccaaauccaagcuccagauuaaucggcaggucaucguggaccgcagcgauagaucuggauacuccggcauuuucagcgucgagggcaaauccuguaucaaccggugcuuuuauguggaacugauuagagggcgcaaggaggaaaccgagguucuguggaccucuaauagcaucguggucuucuguggaacauccggcaccuacgggacaggaucuuggccugacggcgcugaucucaaccugaugcccauuuga

SEQ ID NO: 205981 - RNA, 1410 nt, Artificial Sequence
  derived and/or modified sequence opt5 from neuraminidase__InfluenzaA__AFN19432
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgccccacagaacacugcucaugaaugaacugggcgugccuuuucaucuggggaccaagcaggucugcauugccugguccucuagcuccugucacgacggaaaagccuggcuccaugugugcaucacaggcgaugacaagaacgcuaccgccagcuucauuuauaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucacaccuccacacucucuggaagcgcgcaacacguggaggaaugcuccugcuaccccagauauccuggcgugcggugugucugccgcgacaacuggaaggggagcaauagacccaucguggauauuaacaucaaagaccauucuauuguuuccagcuacguguguucuggacuggucggcgacaccccgcggaagaaugauagcuccucuagcucccacugccuugacccuaacaaugaggaaggcgggcauggagugaaaggcugggccuucgaugacgggaacgauguuuggaugggacgcacgaucaaugagacaagcagacugggcuacgagaccuuuaaggugaucgaaggguggucuaaccccaaauccaagcuccagauuaaucggcaggucaucguggaccgcggagauagaagcggcuauucuggcauuuucuccgucgaggggaaaagcuguaucaaccggugcuuuuacguggaacugauuagaggacgcaaggaggaaaccgagguucuguggacauccaauucuaucguggucuucuguggcaccagcgggacauauggaacgggcuccuggccugacggggcugaucucaaccugaugcccauuuga

SEQ ID NO: 205982 - RNA, 1410 nt, Artificial Sequence
  derived and/or modified sequence opt5 from neuraminidase__InfluenzaA__AFN19434
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauucuguuuaucgaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgauuaaugagacaagcagacugggcuaugagaccuuuaaggugaucgaaggguggucuaaccccaaauccaagcuccagaucaaucggcaggucauuguggaccgcagcgauagaucuggauacuccggcaucuucagcgucgagggcaaauccuguauuaaccggugcuuuuauguggaacugaucagagggcgcaaggaggaaaccgagguucuguggacaucuaauagcauuguggucuucuguggaaccuccggcacauacgggacgggaucuuggccugacggcgcugaucucaaccugaugcccaucuga

SEQ ID NO: 205983 - RNA, 1410 nt, Artificial Sequence; identical to SEQ ID NO: 205170
  derived and/or modified sequence opt5 from neuraminidase__InfluenzaA__AFN19436

SEQ ID NO: 205984 - RNA, 1410 nt, Artificial Sequence
  derived and/or modified sequence opt5 from neuraminidase__InfluenzaA__AFN19438
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauucuguuuaucgaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgauuaaugagacaagcagacugggcuaugagaccuuuaaggugaucgaaggguggucuaaccccaaauccaagcuccagaucaaucggcaggucauuguggaccgcagcgauagaucuggauacuccggcaucuucagcgucgagggcaaauccuguauuaaccggugcuuuuauguggaacugaucagagggcgcaaggaggaaaccgagguucuguggacaucuaauagcauuguggucuucuguggaaccuccggcacauacgggacgggaucuuggccugacggcgcugaucucaaccugaugagcaucuga

SEQ ID NO: 205985 - RNA, 1410 nt, Artificial Sequence
  derived and/or modified sequence opt5 from neuraminidase__InfluenzaA__AFN19442
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccauuaucgagaaggaaauuugcccuaaacccacggaguaccggaauugguccaagccucagugugacaucaccggguucgcucccuuuucuaaagauaacagcauccgccucuccgccggaggcgacauuugggugacaagagagccuuaugucucuugcgauccggacaaguguuaccaauucgcgcuggggcagggaaccacacuuaauaacgugcauagcaauaacaccguucgggaucgcacgcccuauagaacacugcucaugaaugaacugggcgugccuuuucaccuggggaccaagcaggucugcaucgcuugguccucuagcuccugucaugacggaaaagccuggcuccacgugugcauuacaggcgaugacaagaacgccaccgcuagcuucaucuacaauggccggcugguugauucuguggucuccuggagcaaagagauucuucgcacccaggaaucugagugugugugcaucaacgggacauguacgguggucaugaccgacggauccgccagcggcaaggcugauacaaaaauccuguuuauugaggaagggaagaucguucauaccuccacacucucuggaagcgcccaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggcguucgaugacgggaacgauguuuggaugggacgcacgaucaaugagacaagcagacugggcuaugagaccuuuaaggugauugaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaaccgagguucuguggacauccaauucuauuguggucuucuguggcaccagcgggacauacggaacgggcuccuggccugacggggccgaucucaaccugaugcauaucuga

SEQ ID NO: 205986 - RNA, 1410 nt, Artificial Sequence; identical to SEQ ID NO: 205170
  derived and/or modified sequence opt5 from neuraminidase__InfluenzaA__AFN19446

SEQ ID NO: 205987 - RNA, 1410 nt, Artificial Sequence; identical to SEQ ID NO: 205170
  derived and/or modified sequence opt5 from neuraminidase__InfluenzaA__AFN19448

SEQ ID NO: 205988 - RNA, 1410 nt, Artificial Sequence; identical to SEQ ID NO: 205946
  derived and/or modified sequence opt5 from neuraminidase__InfluenzaA__AFN19458

SEQ ID NO: 205989 - RNA, 1410 nt, Artificial Sequence
  derived and/or modified sequence opt5 from neuraminidase__InfluenzaA__AFN19460
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaacgagauccuucgcacccaggaaucugagugugucugcauuaacggaacauguacgguggugaugaccgauggcuccgcuagcgggaaagccgacacaaagauccuguuuaucgaggaaggaaaaauuguccauaccuccacacucucuggcagcgcgcaacacguugaggaaugcuccugcuaucccagauacccuggggugcggugugugugccgcgauaauuggaagggaagcaacagacccaucgucgacauuaauaucaaggaucacucuauuguguccagcuacguuuguucuggccuggugggcgacaccccgcggaaaaacgacagcuccucuagcucccauugccuugauccuaauaacgaggaagggggacacggcgucaaggggugggccuucgacgauggaaaugacguguggaugggccgcacgaucaacgagacaagcagacugggguaugagaccuuuaaaguuaucgaaggauggucuaaucccaaguccaaacuccagauuaaccgccaggugaucgucgaucggggcgacagaagcggcuacucugggauuuucuccguggagggaaagagcuguaucaaucggugcuuuuaugucgaacugauuagaggccgcaaagaggaaaacgaggugcuguggaccuccaauucuaucguuguguucugugggacaagcggaaccuacggcacaggguccuggccugauggcgcugaccucaaccugaugcccauuuga

SEQ ID NO: 205990 - RNA, 1410 nt, Artificial Sequence; identical to SEQ ID NO: 205170
  derived and/or modified sequence opt5 from neuraminidase__InfluenzaA__AFN19462

SEQ ID NO: 205991 - RNA, 1410 nt, Artificial Sequence
  derived and/or modified sequence opt5 from neuraminidase__InfluenzaA__AFN19466
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauugccggguucgcgcccuuuucuaaagauaacagcauccgccucuccgcuggaggcgacaucugggugaccagagagccuuaugucucuugcgauccggacaaguguuaccaauucgcccuggggcagggaacaacccuuaauaacgugcauagcaauaacacaguucgggaucgcacccccuauagaacgcugcucaugaaugaacugggcgugccuuuucaccuggggacaaagcaggucugcauugccugguccucuagcuccugucaugacggaaaggcuuggcuccacgugugcaucaccggcgaugacaaaaacgccacagcuagcuucauuuacaauggccggcugguugauucuguggucuccuggagcaaagagauccuucgcacccaggaaucugagugugugugcauuaacgggaccuguacaguggucaugacggacggauccgccagcggcaaggcggauaccaaaauccuguuuaucgaggaagggaagauuguucauacauccacccucucuggaagcgcccaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacacaccgcggaagaaugauagcuccucuagcucccauugccuugacccuaacaaugaggaaggcgggcacggagugaaaggcugggcuuucgaugacgggaacgauguuuggaugggacgcaccaucaaugagacgagcagacugggcuaugagacauuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggaccuccaauucuaucguggucuucuguggcacaagcgggaccuacggaacaggcuccuggccugacggggccgaucucaaccugaugcccauuuga

SEQ ID NO: 205992 - RNA, 1410 nt, Artificial Sequence; identical to SEQ ID NO: 205170
  derived and/or modified sequence opt5 from neuraminidase__InfluenzaA__AFN19468

SEQ ID NO: 205993 - RNA, 1410 nt, Artificial Sequence
  derived and/or modified sequence opt5 from neuraminidase__InfluenzaA__AFN19470
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauucuguuuaucgaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgauuaaugagacaagcagacugggcuaugagaccuuuaaggugaucgaaggguggucuaaccccaaauccaagcuccagaucaaucggcaggucauugugaacaaaagcgaccgcucuggauacuccggcaucuucagcgucgagggcaaguccuguauuaauagaugcuuuuauguggaacugauccgggggagaaaggaggaaaccgagguucuguggacaucuaacagcauuguggucuucuguggaaccuccggcacauacgggacgggaucuuggccugauggcgcugaccucaaucugaugcccaucuga

SEQ ID NO: 205994 - RNA, 1410 nt, Artificial Sequence; identical to SEQ ID NO: 205946
  derived and/or modified sequence opt5 from neuraminidase__InfluenzaA__AFN19472

SEQ ID NO: 205995 - RNA, 1410 nt, Artificial Sequence
  derived and/or modified sequence opt5 from neuraminidase__InfluenzaA__AFN19476
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcgccccucucuaaagacaacagcauccgccuguccgccggcggggauaucugggugacaagagagccuuaugucucuugcgacccggauaaguguuaccaauuugcucuuggacagggcaccacacugaauaacgugcauagcaauaacaccguucgggaccgcacgcccuauagaacacuccugaugaaugaacugggggugccuuuccaccucggaaccaagcaggucugcauugccugguccuccucuuccugucaugauggcaaagccuggcugcacgugugcaucacaggcgacgauaagaacgcuaccgccagcuuuauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuucaucgaggaaggaaagauuguucauaccuccacacugucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuugucggcgacaccccgcggaagaaugacagcuccucuagcucccauugccuggauccuaacaaugaggaagggggacacggcgugaaagggugggccuuugacgauggaaacgacguuuggaugggccgcacgaucaaugagacaagcagacucggguaugagaccuucaaggugaucgaaggauggucuaaccccaaauccaagcugcagauuaaucggcaggucaucguggaucgcggcgacagaagcggcuacucugggauuuuuagcgucgagggaaaaagcuguaucaaccggugcuucuauguggaacugauuagaggccgcaaggaggaaaccgagguucucuggacauccaauucuaucguggucuuuugugggaccagcggaacauacggcacgggguccuggccugauggcgcugaccugaaccuuaugcccauuuga

SEQ ID NO: 205996 - RNA, 1410 nt, Artificial Sequence; identical to SEQ ID NO: 205946
  derived and/or modified sequence opt5 from neuraminidase__InfluenzaA__AFN19478

SEQ ID NO: 205997 - RNA, 1410 nt, Artificial Sequence
  derived and/or modified sequence opt5 from neuraminidase__InfluenzaA__AFN19480
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguuggcgaucggacgcccuaucgcacacugcucaugaaugaacugggggugccuuuucaccugggaaccaagcaggucugcaucgccugguccucuagcuccugucaugacggcaaagccuggcuccacgugugcauuacaggcgaugacaagaacgcuaccgccagcuucaucuacaaugggagacugguugauucuguggucuccuggagcaaagagauucuucggacccaggaaucugagugugugugcaucaacggaacauguacgguggucaugaccgacggcuccgcuagcgggaaggccgauacaaaaauucuguuuaucgaggaaggaaagaucguucauaccuccacacucucuggcagcgcgcaacacguggaggaaugcuccugcuauccccgcuacccuggggugagaugugucugccgggacaacuggaagggaagcaaucgccccauuguggauaucaacauuaaagaccacucuaucguuuccagcuacguguguucuggccuggucggcgacaccccgagaaagaaugauagcuccucuagcucccauugccuugacccuaacaaugaggaagggggacacggcgugaaagggugggccuucgaugacggaaacgauguuuggaugggccggacgauuaaugagacaagccgccugggguaugagaccuuuaaggugaucgaaggauggucuaaccccaaauccaagcuccagaucaauagacaggucauuguggaccggagcgaucgcucuggcuacuccggcaucuucagcgucgaggggaaauccuguauuaacagaugcuuuuauguggaacugauccggggaagaaaggaggaaaccgagguucuguggacaucuaauagcauuguggucuucuguggcaccuccgggacauacggaacgggcucuuggccugacggggcugaucucaaccugaugcccaucuga

SEQ ID NO: 205998 - RNA, 1410 nt, Artificial Sequence
  derived and/or modified sequence opt5 from neuraminidase__InfluenzaA__AFN19482
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcuaaguaccggaauugguccaaaccucagugugacauuaccggguucgcccccuuuucuaaggauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugagcugggcgugccuuuucaccuggggaccaaacaggucugcauugccugguccucuagcuccugucaugacggaaaggccuggcuccacgugugcaucacaggcgaugacaaaaacgcuaccgccagcuucauuuacaauggccggcugguugauucuguggucuccuggagcaaggaaauccuucgcacccaggagucugaaugugugugcauuaacgggacauguacgguggucaugaccgacggauccgcuagcggcaaagccgauacaaagauccuguuuaucgaggaggggaagauuguucauaccuccacacucucuggaagcgcgcaacacguggaagagugcuccugcuaucccagauacccuggcgugcggugugucugccgcgacaacuggaaagggagcaauagacccaucguggauauuaacaucaaggaccacucuauuguuuccagcuacguguguucuggacuggucggcgacaccccgcggaaaaaugauagcuccucuagcucccauugccuugacccuaacaaugaagagggcgggcacggagugaagggcugggccuucgaugacgggaacgauguuuggaugggacgcacgaucaaugaaacaagcagacugggcuaugagaccuuuaaagugaucgagggguggucuaaccccaaguccaaacuccagauuaaucggcaggucaucguggaccgcagcgauagaucuggauacuccggcauuuucagcgucgaaggcaaguccuguaucaaccggugcuuuuauguggagcugauuagagggcgcaaggaagagaccgaaguucuguggacaucuaauagcaucguggucuucuguggaaccuccggcacauacgggacgggaucuuggccugacggcgcugaucucaaccugaugcccauuuga

SEQ ID NO: 205999 - RNA, 1410 nt, Artificial Sequence; identical to SEQ ID NO: 205170
  derived and/or modified sequence opt5 from neuraminidase__InfluenzaA__AFN19484

SEQ ID NO: 206000 - RNA, 1410 nt, Artificial Sequence; identical to SEQ ID NO: 205946
  derived and/or modified sequence opt5 from neuraminidase__InfluenzaA__AFN19488

SEQ ID NO: 206001 - RNA, 1410 nt, Artificial Sequence
  derived and/or modified sequence opt5 from neuraminidase__InfluenzaA__AFN19492
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggcaaacugguugauucuguggucuccuggagcaaggagauccuucggacccaggaaucugagugugugugcauuaacgggacauguacgguggucaugaccgacggauccgcuagcggcaaagccgauacaaagauccuguuuaucgaggaagggaagauuguucauaccuccacacucucuggaagcgcgcaacacguggaggaaugcuccugcuauccccgcuacccuggcgugagaugugucugccgggacaacuggaaagggagcaaucgccccaucguggauauuaacaucaaggaccacucuauuguuuccagcuacguguguucuggacuggucggcgacaccccgagaaagaaugauagcuccucuagcucccauugccuugacccuaacaaugaggaaggcgggcacggagugaagggcugggccuucgaugacgggaacgauguuuggaugggacggacgaucaaugagacaagccgccugggcuaugagaccuuuaaagugaucgaaggguggucuaaccccaaguccaaacuccagauuaauagacaggucaucguggaccggggagaucgcagcggcuacucuggcauuuucuccgucgaggggaaaagcuguaucaacagaugcuuuuauguggaacugauucggggaagaaaggaggaaaccgagguucuguggacauccaauucuaucguggucuucuguggcaccagcgggacauacggaacgggcuccuggccugacggggcugaucucaaccugaugcccauuuga

SEQ ID NO: 206002 - RNA, 1410 nt, Artificial Sequence
  derived and/or modified sequence opt5 from neuraminidase__InfluenzaA__AFN19494
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacaugcauagcaauaacaccgugcgggaucgcacgccguauagaacacuccugaugaaugaacugggcguucccuuucaccucgggaccaaacaggugugcauugccugguccucuagcuccugucaugacggaaaggccuggcugcacgucugcaucacaggcgaugacaagaacgcuaccgccagcuucauuuacaauggccggcuuguggauucuguuguguccuggagcaaagagauccugcgcacccaggaaucugagugugucugcauuaacgggacauguacgguggugaugaccgacggauccgcuagcggcaaggccgauacaaaaauccucuuuaucgaggaagggaagauuguccauaccuccacacugucuggaagcgcgcaacacguugaggaaugcuccugcuauccuagauaccccggcgugcggugugugugccgcgacaacuggaaggggagcaauagaccuaucgucgauauuaacaucaaagaccacucuauuguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucaaugagacaagcagacucggcuaugagaccuuuaagguuaucgaaggguggucuaacccuaaauccaagcugcagauuaaucgccaggugaucgucgaccggggaaacagaagcggcuacucuggcauuuucuccguggaggggaaaagcuguaucaaucggugcuuuuaugucgaacugauuagaggacgcaaggaggaaaccgaggugcucuggacauccaacucuaucguuguguucuguggcaccagcgggacauacggaacgggcuccuggcccgauggggcugaccugaaucuuaugccuauuuga

SEQ ID NO: 206003 - RNA, 1410 nt, Artificial Sequence; identical to SEQ ID NO: 204811
  derived and/or modified sequence opt5 from neuraminidase__InfluenzaA__AFN19496

SEQ ID NO: 206004 - RNA, 1410 nt, Artificial Sequence
  derived and/or modified sequence opt5 from neuraminidase__InfluenzaA__AFN19498
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaagggcugggccuucgaugacgggaacgauguuuggaugggacggacgaucaaugagacaagccgccucggcuaugagaccuuuaaagugaucgaaggguggucuaacccuaaguccaaacugcagauuaauagacaggucaucguggaccggggaaaccgcagcggcuacucuggcauuuucuccgucgaggggaaaagcuguaucaauagaugcuuuuauguggaacugauucggggaagaaccgaggaaacagagguucucuggaccuccaacucuaucguggucuucuguggcacaagcgggacguacggaaccggcuccuggcccgauggggcugaccugaaucuuaugccuauuuga

SEQ ID NO: 206005 - RNA, 1410 nt, Artificial Sequence; identical to SEQ ID NO: 205954
  derived and/or modified sequence opt5 from neuraminidase__InfluenzaA__AFN19500

SEQ ID NO: 206006 - RNA, 1410 nt, Artificial Sequence; identical to SEQ ID NO: 205946
  derived and/or modified sequence opt5 from neuraminidase__InfluenzaA__AFN19502

SEQ ID NO: 206007 - RNA, 1410 nt, Artificial Sequence; identical to SEQ ID NO: 202542
  derived and/or modified sequence opt5 from neuraminidase__InfluenzaA__AFN19504

SEQ ID NO: 206008 - RNA, 1410 nt, Artificial Sequence; identical to SEQ ID NO: 202542
  derived and/or modified sequence opt5 from neuraminidase__InfluenzaA__AFN19506

SEQ ID NO: 206009 - RNA, 1410 nt, Artificial Sequence; identical to SEQ ID NO: 205954
  derived and/or modified sequence opt5 from neuraminidase__InfluenzaA__AFN19508

SEQ ID NO: 206010 - RNA, 1410 nt, Artificial Sequence; identical to SEQ ID NO: 205946
  derived and/or modified sequence opt5 from neuraminidase__InfluenzaA__AFN19510

SEQ ID NO: 206011 - RNA, 1410 nt, Artificial Sequence; identical to SEQ ID NO: 205946
  derived and/or modified sequence opt5 from neuraminidase__InfluenzaA__AFN19512

SEQ ID NO: 206012 - RNA, 1410 nt, Artificial Sequence; identical to SEQ ID NO: 205946
  derived and/or modified sequence opt5 from neuraminidase__InfluenzaA__AFN19516

SEQ ID NO: 206013 - RNA, 1410 nt, Artificial Sequence; identical to SEQ ID NO: 205954
  derived and/or modified sequence opt5 from neuraminidase__InfluenzaA__AFN19518

SEQ ID NO: 206014 - RNA, 1410 nt, Artificial Sequence; identical to SEQ ID NO: 205954
  derived and/or modified sequence opt5 from neuraminidase__InfluenzaA__AFN19520

SEQ ID NO: 206015 - RNA, 1410 nt, Artificial Sequence; identical to SEQ ID NO: 205946
  derived and/or modified sequence opt5 from neuraminidase__InfluenzaA__AFN19522

SEQ ID NO: 206016 - RNA, 1410 nt, Artificial Sequence
  derived and/or modified sequence opt5 from neuraminidase__InfluenzaA__AFN19524
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggacauccaauucuaucguggucuucuguggcaccagcgggacauacggaacgggcuccuggccugacggggcugaucucucucugaugcccauuuga

SEQ ID NO: 206017 - RNA, 1410 nt, Artificial Sequence
  derived and/or modified sequence opt5 from neuraminidase__InfluenzaA__AFN19526
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgaccgagaaggaaauuuguccuaaacccgcugaguaucggaauugguccaagccucagugcgacaucacaggguucgcccccuuuucuaaagauaacagcauucgccucuccgcgggaggcgacaucugggugaccagagagccuuacgucucuugugauccggacaagugcuaucaauucgcucuggggcagggaacaacccuuaauaacgugcauagcaauaacacgguucgggaucgcacacccuacagaacccugcucaugaaugaacugggcgugccuuuucaccuggggacaaagcaggucuguaucgccugguccucuagcuccugccaugacggaaaagccuggcuccacguguguauuaccggcgaugacaagaacgcuaccgccagcuucaucuauaauggccggcugguugauucuguggucuccuggagcaaagagauucuucgcacacaggaaucugagugcguguguaucaacgggacgugcaccguggucaugacagacggauccgcuagcggcaaggccgauaccaaaauucuguuuaucgaggaagggaagaucguucauacauccacccucucuggaagcgcgcaacacguggaggaaugcuccuguuaccccagauauccuggcgugcggugcgucugucgcgacaacuggaaggggagcaauagacccauuguggauaucaacauuaaagaccacucuaucguuuccagcuacgugugcucuggacuggucggcgacacgccgcggaagacagauagcuccucuagcucccauugucuugacccuaauaacgaggaaggcgggcacggagugaaaggcugggccuucgaugacgggaaugauguuuggaugggacgcaccauuaacgagaccagcagacugggcuacgagacauuuaaggugaucgaaggguggucuaaucccaaauccaagcuccagaucaaccggcaggucauuguggaccgcggagauagaagcggcuauucuggcaucuucuccgucgaggggaaaagcugcauuaaucgguguuuuuacguggaacugaucagaggacgcaaggaggaaaccgagguucuguggacauccaacucuauuguggucuucugcggcacgagcgggaccuauggaacaggcuccuggccugacggggcugaucucaaucugaugcccaucuga

SEQ ID NO: 206018 - RNA, 1410 nt, Artificial Sequence
  derived and/or modified sequence opt5 from neuraminidase__InfluenzaA__AFN19528
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaguccgauacaaaaauucuguuuaucgaggaagggaagaucguucauaccucuacacucagcggauccgcccaacacguggaggaaugcagcugcuaucccagauacccuggcgugcggugugucugccgcgacaacuggaaggggucuaauagacccauuguggauaucaacauuaaagaccacuccaucguuagcucuuacguguguagcggacuggucggcgacaccccgcggaagaaugauuccucuagcuccagccauugccuugacccuaacaaugaggaaggcgggcacggagugaaaggcugggcguucgaugacgggaacgauguuuggaugggacgcacgauuaaugagacaucuagacugggcuaugagaccuuuaaggugaucgaagggugguccaaccccaaaagcaagcuccagaucaaucggcaggucauuguggaccgcucugauagauccggauacagcggcaucuucuccgucgagggcaaaucuuguauuaaccggugcuuuuauguggaacugaucagagggcgcaaggaggaaaccgagguucuguggacaagcaauuccauuguggucuucuguggaaccucuggcacauacgggacgggaagcuggccugacggcgccgaucucaaccugaugcccaucuga

SEQ ID NO: 206019 - RNA, 1410 nt, Artificial Sequence; identical to SEQ ID NO: 205982
  derived and/or modified sequence opt5 from neuraminidase__InfluenzaA__AFN19530

SEQ ID NO: 206020 - RNA, 1410 nt, Artificial Sequence; identical to SEQ ID NO: 205946
  derived and/or modified sequence opt5 from neuraminidase__InfluenzaA__AFN19532

SEQ ID NO: 206021 - RNA, 1410 nt, Artificial Sequence; identical to SEQ ID NO: 205982
  derived and/or modified sequence opt5 from neuraminidase__InfluenzaA__AFN19534

SEQ ID NO: 206022 - RNA, 1410 nt, Artificial Sequence; identical to SEQ ID NO: 205946
  derived and/or modified sequence opt5 from neuraminidase__InfluenzaA__AFN19536

SEQ ID NO: 206023 - RNA, 1410 nt, Artificial Sequence; identical to SEQ ID NO: 205946
  derived and/or modified sequence opt5 from neuraminidase__InfluenzaA__AFN19538

SEQ ID NO: 206024 - RNA, 1410 nt, Artificial Sequence; identical to SEQ ID NO: 205946
  derived and/or modified sequence opt5 from neuraminidase__InfluenzaA__AFN19544

SEQ ID NO: 206025 - RNA, 1410 nt, Artificial Sequence
  derived and/or modified sequence opt5 from neuraminidase__InfluenzaA__AFN19546
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucauguccgaacugggggugccuuuucaccugggaaccaagcaggucugcauugccuggucuagcuccagcugucaugauggcaaagccuggcuccacgugugcaucacaggcgacgauaagaaugcuaccgccucuuucauuuacaacgggcggcugguugacuccguggucagcuggucuaaagagauccuucgcacccaggaauccgagugugugugcauuaauggaacauguacgguggucaugaccgauggcagcgcuuccgggaaggccgacacaaaaauccuguuuaucgaggaaggaaagauuguucauaccucuacacucagcggcuccgcgcaacacguggaggaaugcagcugcuaucccagauacccuggggugcggugugucugccgcgauaacuggaagggaucuaacagacccaucguggacauuaauaucaaagaucacuccauuguuagcucuuacguguguagcggccuggucggcgacaccccgcggaagaacgacuccucuagcuccagccauugccuugauccuaauaacgaggaagggggacacggcgugaaagggugggccuucgacgauggaaaugacguuuggaugggccgcacgaucaacgagacaucuagacugggguaugagaccuuuaaggugaucgaaggaugguccaaucccaaaagcaagcuccagauuaaccggcaggucaucguggaucgcggcgacagaucuggcuacuccgggauuuucagcgucgagggaaaauccuguaucaaucggugcuuuuauguggaacugauuagaggccgcaaggaggaaaccgagguucuguggacaucuaacagcaucguggucuucugugggaccuccggaacauacggcacggggucuuggccugauggcgcugaccucaaucugaugcccauuuga

SEQ ID NO: 206026 - RNA, 1410 nt, Artificial Sequence
  derived and/or modified sequence opt5 from neuraminidase__InfluenzaA__AFN19548
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuucuuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuucuccucuagccauugccuugacccuaacaaugaggaaggcgggcacggagugaaaggcugggccuuugaugacgggaacgauguuuggaugggacgcacgaucaaugagacauccagacugggcuaugagaccuucaaggugaucgaaggguggagcaaccccaaaucuaagcuccagauuaaucggcaggucaucguggaccgcggagauagauccggcuacagcggcauuuuuagcgucgaggggaaauccuguaucaaccggugcuucuauguggaacugauuagaggacgcaaggaggaaaccgagguucuguggacaagcaauuccaucguggucuucuguggcaccucugggacauacggaacgggcagcuggccugacggggcugaucucaaccugaugcccauuuga

SEQ ID NO: 206027 - RNA, 1410 nt, Artificial Sequence
  derived and/or modified sequence opt5 from neuraminidase__InfluenzaA__AFN19550
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcgaggccgauacaaagauccucuuuaucgaagaggggaaaauuauccauaccuccacacugucuggaagcgcgcaacacguugaagagugcuccugcuauccuagauaccccggcgugcggugugugugccgcgacaacuggaaggggagcaauagaccuauugucgauaucaacauuaaggaccacucuaucguguccagcuacguuuguucuggacuugugggcgacacgccccggaaaaaugauagcuccucuagcucccauugccuggacccgaacaaugaagagggcgggcacggagucaagggcugggccuucgaugacgggaacgauguguggaugggacgcaccaucaaugagacaagcagacucggcuaugaaaccuuuaaaguuauugagggguggucuaacccuaaguccaaacugcagaucaaucgccaggugauugucgaccggggaaacagaagcggcuacucuggcaucuucuccguggaagggaagucuuguauuaaucggugcuuuuaugucgagcugaucagaggacgcaaagaagagaccgaggugcucuggacauccaacucuauuguuguguucuguggcaccagcgggacauacggaacgggcuccuggcccgauggggcugaccugaaucuuaugccuaucuga

SEQ ID NO: 206028 - RNA, 1410 nt, Artificial Sequence; identical to SEQ ID NO: 205946
  derived and/or modified sequence opt5 from neuraminidase__InfluenzaA__AFN19552

SEQ ID NO: 206029 - RNA, 1410 nt, Artificial Sequence; identical to SEQ ID NO: 205170
  derived and/or modified sequence opt5 from neuraminidase__InfluenzaA__AFN19554

SEQ ID NO: 206030 - RNA, 1410 nt, Artificial Sequence; identical to SEQ ID NO: 205170
  derived and/or modified sequence opt5 from neuraminidase__InfluenzaA__AFN19556

SEQ ID NO: 206031 - RNA, 1410 nt, Artificial Sequence
  derived and/or modified sequence opt5 from neuraminidase__InfluenzaA__AFN19558
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagaugaaucggcaggucauuguggaccgcggagauagaagcggcuacucuggcaucuucuccgucgaggggaaaagcuguauuaaccggugcuuuuauguggaacugaucagaggacgcaaggaggaaaccgagguucuguggacauccaauucuauuguggucuucuguggcaccagcgggacauacggaacgggcuccuggccugacggggcugaucucaaccugaugcccaucuga

SEQ ID NO: 206032 - RNA, 1410 nt, Artificial Sequence
  derived and/or modified sequence opt5 from neuraminidase__InfluenzaA__AFN19560
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaagggggaggccacggggugaaaggaugggccuucgacgauggcaacgacguuuggauggggcgcacgaucaaugagacaagcagacugggauaugagaccuuuaaggugaucgagggcuggucuaaccccaaauccaagcuccagauuaaucggcaggucaucguggaucgcggcgacagaagcggguacucuggaauuuucuccgucgaaggcaaaagcuguaucaaccggugcuuuuauguggagcugauuagagggcgcaaggaagagaccgaaguucuguggacauccaauucuaucguggucuucuguggaaccagcggcacauacgggacgggcuccuggccugauggagcugaccucaaccugaugcccauuuga

SEQ ID NO: 206033 - RNA, 1410 nt, Artificial Sequence; identical to SEQ ID NO: 205993
  derived and/or modified sequence opt5 from neuraminidase__InfluenzaA__AFN19562

SEQ ID NO: 206034 - RNA, 1410 nt, Artificial Sequence
  derived and/or modified sequence opt5 from neuraminidase__InfluenzaA__AFN19564
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagacggacagcuccucuagcucccauugccuugauccuaauaacgaggaagggggacacggcgugaaagggugggccuucgacgauggaaaugacguuuggaugggccgcacaaucaacgagaccagcagacugggguaugagaccuuuaaggugaucgaaggauggucuaaucccaaauccaagcuccagauuaaccggcaggucaucguggaucgcggcgacagaagcggcuacucugggauuuucuccgucgagggaaaaagcuguaucaaucggugcuuuuauguggaacugauuagaggccgcaaggaggaaacagagguucuguggaccuccaacucuaucguggucuucugugggacaagcggaacguacggcaccggguccuggccugauggcgcugaccucaaucugaugcccauuuga

SEQ ID NO: 206035 - RNA, 1410 nt, Artificial Sequence
  derived and/or modified sequence opt5 from neuraminidase__InfluenzaA__AFN19566
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaacgagauccuucgcacccaggaaucugagugugugugcauuaacggaacauguacgguggucaugaccgauggcuccgcuagcgggaaagccgacacaaagauccuguuuaucgaggaaggaaaaauuguucauaccuccacacucucuggcagcgcgcaacacguggaggaaugcuccugcuaucccagauacccuggggugcggugugucugccgcgauaauuggaagggaagcaacagacccaucguggacauuaauaucaaggaucacucuauuguuuccagcuacguguguucuggccuggucggcgacaccccgcggaaaaacgacagcuccucuagcucccauugccuugauccuaauaacgaggaagggggacacggcgugaaggggugggccuucgacgauggaaaugacguuuggaugggccgcacgaucaacgagacaagcagacugggguaugagaccuuuaaagugaucgaaggauggucuaaucccaaguccaaacuccagauuaaccggcaggucaucguggaucgcggcgacagaagcggcuacucugggauuuucuccgucgagggaaagagcuguaucaaucggugcuuuuauguggaacugauuagaggccgcaaagaggaaaacgagguucuguggaccuccaauucuaucguggucuucugugggacaagcggaaccuacggcacaggguccuggccugauggcgcugaccucaaccugaugcccauuuga

SEQ ID NO: 206036 - RNA, 1410 nt, Artificial Sequence
  derived and/or modified sequence opt5 from neuraminidase__InfluenzaA__AFN19568
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccaggucaaucgccaggugauugucgaucggggcgacagaagcggcuacucugggaucuucuccguggagggaaaaagcuguauuaaccggugcuuuuauguugaacugaucagaggccgcaaggaggaaauugaggugcuguggaccuccaauucuaucgucguguucugugggacaagcggaaccuacggcacaggguccuggccugauggcgcugaccucaaccugaugcccauuuga

SEQ ID NO: 206037 - RNA, 1410 nt, Artificial Sequence
  derived and/or modified sequence opt5 from neuraminidase__InfluenzaA__AFN19570
augaaccccaaucagaagaucauuaccaucggcagcgugucccugacaauuucuacgaucugcuucuuuaugcaaauugccauccucaucaccacagucacccugcacuucaaacaguacgaguuuaacuauccuccgaauaaccagguuaugcuuugugaacccacaauuaucgagagaaauauuaccgaaaucguguaccugacaaacaccacgauugagaaggaaaucugcccuaaacccgcugaguaucggaauuggagcaagccucagugugggauuaccggauucgcccccuuuuccaaagacaacucuauccgccucagcgcgggcggggauaucugggugacaagagagccuuacgucuccugcgacccggauaaguguuaucaauucgcucugggacagggcaccacacuuaauaacaugcauucuaauaacaccgugcgggaccgcacgcccuacagaacacugcucaugaaugaacuggggguuccuuuucaccugggaaccaaacaggugugcauugccuggagcuccagcucuugucaugauggcaaggccuggcuccacgucugcaucacaggcgacgauaagaacgcuaccgccuccuucauuuauaaugggcggcugguggacagcguugugucuugguccaacgagauccuucgcacccaggaaagcgagugugucugcauuaacggaacauguacgguggugaugaccgauggcucugcuuccgggaaagccgacacaaagauccuguuuaucgaggaaggaaaaauuguccauaccagcacacucuccggcucugcgcaacacguugaggaaugcagcugcuaccccagauacccuggggugcggugugugugccgcgauaauuggaagggauccaacagacccaucgucgacauuaauaucaaggaucacagcauugugucuuccuauguuuguagcggccuggugggcgacaccccgcggaaaaacgacucuagcuccucuagccauugccuugauccuaauaacgaggaagggggacacggcgucaaggggugggccuucgacgauggaaaugacguguggaugggccgcacgaucaacgagacauccagacugggguacgagaccuuuaaaguuaucgaaggauggagcaaucccaagucuaaacuccagauuaaccgccaggugaucgucgaucggggcgacagauccggcuauagcgggauuuucucuguggagggaaaguccuguaucaaucggugcuuuuacgucgaacugauuagaggccgcaaagaggaaaacgaggugcuguggaccagcaauuccaucguuguguucugugggacaucuggaaccuauggcacagggagcuggccugauggcgcugaccucaaccugaugcccauuuga

SEQ ID NO: 206038 - RNA, 1410 nt, Artificial Sequence
  derived and/or modified sequence opt5 from neuraminidase__InfluenzaA__AFN19572
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgcaucuccgcgggaggcgacauuugggugacaagagagccuuaugucucuugcgauccggacaaguguuaccaauucgcucucgggcagggaaccacacugaauaacgugcauagcaauaacaccguucgggaucgcacgcccuauagaacacuucugaugaaugaacucggcgugccuuuucaccuggggaccaagcaggucugcaucgccugguccucuagcuccugucaugacggaaaagccuggcugcacgugugcauuacaggcgaugacaagaacgcuaccgccagcuucaucuacaauggcaaacucguugauucuguggucuccuggagcaaggagauucugcggacccaggaaucugagugugugugcaucaacgggacauguacgguggucaugaccgacggauccgcuagcggcaaagccgauacaaagauccuuuuuauugaggaagggaagaucguucauaccuccacacugucuggaagcgcgcaacacguggaggaaugcuccugcuauccccgcuacccuggcgugagaugugucugccgggacaacuggaaagggagcaaucgccccauuguggauaucaacauuaaggaccacucuaucguuuccagcuacguguguucuggacucgucggcgacaccccgagaaagaaugauagcuccucuagcucccauugccuggacccuaacaaugaggaaggcgggcacggagugaagggcugggccuucgaugacgggaacgauguuuggaugggacggacgaucaaugagacaagccgccuuggcuaugagaccuuuaaagugauugaaggguggucuaaccccaaguccaaacugcagaucaauagacaggucauuguggaccggggagaucgcagcggcuacucuggcaucuucuccgucgaggggaaaagcuguauuaacagaugcuuuuauguggaacucauccggggaagaaaggaggaaaccgagguucuguggacauccaauucuauuguggucuucuguggcaccagcgggacauacggaacgggcuccuggccugacggggcugaucugaaccucaugcccaucuga

SEQ ID NO: 206039 - RNA, 1410 nt, Artificial Sequence
  derived and/or modified sequence opt5 from neuraminidase__InfluenzaA__AFN19574
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaaaagauccugcgcacccaggagucugaaugugugugcauuaacgggacauguacgguggucaugaccgauggauccgcuagcggcaaagccgacacaaagauccucuuuaucgaggaggggaagauuguucauaccuccacacugucuggaagcgcgcaacacguggaagagugcuccugcuauccuagauaccccggcgugcggugugucugccgcgauaauuggaaagggagcaacagaccuaucguggacauuaauaugaaggaucacucuaucguuuccagcuacguguguucuggacuugucggcgacacgccccggaaaaacgacagcuccucuagcucccauugcuucgauccgaaugacgaagagggcgggcacggagugaagggcugggccuuugaugacgggaacgauguuuggaugggacgcaccauuagcgaaaaaucuagacugggcuaugagacauucaaggugaucgaggggugguccaauccuaaaagcaagcuccagaucaaccggcaggucauuguggaccgcggagauagaucuggcuacuccggcaucuuuagcgucgaagggaaguccuguauuaaucggugcuucuauguggagcugaucagaggaucuaaagaagagaccgaaguucuguggaccagcaacuccauuguggucuucuguggcacaucugggaccuacggaacaggcagcuggcccgacggggcugauaucaaucucaugccuauuuga

SEQ ID NO: 206040 - RNA, 1410 nt, Artificial Sequence
  derived and/or modified sequence opt5 from neuraminidase__InfluenzaA__AFN19576
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagaugaugcuuugugaacccacaauuaucgagagaaauauuaccgaaaucguuuaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugugucuugcgauccggacaaguguuaccaauucgcucuggggcagggaaccacacuuaauaacguccauagcaauaacaccgugcgggaucgcacgcccuauagaacacugcucaugaaugaacugggcguuccuuuucaccuggggaccaaacaggugugcauugccugguccucuagcuccugucaugacggaaaggccuggcuccacgucugcaucacaggcgaugacaagaacgcuaccgccagcuucauuuacaauggccggcugguggauucuguuguguccuggagcaaagagauccuucgcacccaggaaucugagugugucugcauuaacgggacauguacgguggugaugaccgacggauccgcuagcggcaaggccgauacaaaaauccuguuuaucgaggaagggaagauuguccauaccuccacacucucuggaagcgcgcaacacguugaggaaugcuccugcuaucccagauacccuggcgugcggugugugugccgcgacaacuggaaggggagcaauagacccaucgucgauauuaacaucaaagaccacucuauuguguccagcuacguuuguucuggacuggugggcgacaccccgcggaagaaugauagcuccucuagcucccauugccuugacccuaacaaugaggaaggcgggcacggagucaaaggcugggccuucgaugacgggaacgauguguggaugggacgcacgaucaaugagacaagcagacugggcuaugagaccuuuaagguuaucgaaggguggucuaaccccaaauccaagcuccagauuaaucgccaggugaucgucgaccggggagauagaagcggcuacucuggcauuuucuccguggaggggaaaagcuguaucaaccggugcuuuuaugucgaacugauuagaggacgcaaggaggaaaccgaggugcuguggacauccaauucuaucguuguguucuguggcaccagcgggacauacggaacgggcuccuggccugacggggcugaucucaaccugaugcccauuuga

SEQ ID NO: 206041 - RNA, 1410 nt, Artificial Sequence; identical to SEQ ID NO: 205946
  derived and/or modified sequence opt5 from neuraminidase__InfluenzaA__AFN19578

SEQ ID NO: 206042 - RNA, 1410 nt, Artificial Sequence; identical to SEQ ID NO: 205946
  derived and/or modified sequence opt5 from neuraminidase__InfluenzaA__AFN19582

SEQ ID NO: 206043 - RNA, 1410 nt, Artificial Sequence; identical to SEQ ID NO: 205946
  derived and/or modified sequence opt5 from neuraminidase__InfluenzaA__AFN19584

SEQ ID NO: 206044 - RNA, 1410 nt, Artificial Sequence; identical to SEQ ID NO: 205946
  derived and/or modified sequence opt5 from neuraminidase__InfluenzaA__AFN19588

SEQ ID NO: 206045 - RNA, 1410 nt, Artificial Sequence; identical to SEQ ID NO: 205946
  derived and/or modified sequence opt5 from neuraminidase__InfluenzaA__AFN19590

SEQ ID NO: 206046 - RNA, 1410 nt, Artificial Sequence; identical to SEQ ID NO: 205982
  derived and/or modified sequence opt5 from neuraminidase__InfluenzaA__AFN19592

SEQ ID NO: 206047 - RNA, 1410 nt, Artificial Sequence; identical to SEQ ID NO: 205946
  derived and/or modified sequence opt5 from neuraminidase__InfluenzaA__AFN19594

SEQ ID NO: 206048 - RNA, 1410 nt, Artificial Sequence; identical to SEQ ID NO: 205954
  derived and/or modified sequence opt5 from neuraminidase__InfluenzaA__AFN19596

SEQ ID NO: 206049 - RNA, 1410 nt, Artificial Sequence; identical to SEQ ID NO: 205954
  derived and/or modified sequence opt5 from neuraminidase__InfluenzaA__AFN19600

SEQ ID NO: 206050 - RNA, 1410 nt, Artificial Sequence
  derived and/or modified sequence opt5 from neuraminidase__InfluenzaA__AFN19602
augaaccccaaucagaagaucauuaccaucggcagcgugucccugacacucucuacgauuugcuucuuuaugcaaaucgccauucugaucaccacagucacccuucacuucaaacaguacgaguuuaacagcccuccgaauaaccagguuaugcugugugaacccacaaucauugagagaaauaugaccgaaaucguguaucucacaaacaccacgauugagaaggaaaucugcccuaaacccgcugaguaccggaauugguccaagccucagugugacauuaccggguucgcccccuuuucuaaagauaacagcauccgccuguccgcgggaggcgacauuugggugacaagagagccuuaugucucuugcgauccggacaaguguuaccaauucgcucuugggcagggaaccacacugaauaacgugcauagcaauaacaccguucgggaucgcacgcccuauagaacacuccugaugaaugaacugggcgugccuuuucaccucgggaccaagcaggucugcaucgccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuauugaggaagggaagaucguucauaccuccacacugucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuugucggcgacaccccgcggaagaaugauagcuccucuagcucccauugccuggacccuaacaaugaggaaggcgggcacggagugaaaggcugggccuucgaugacgggaacgauguuuggaugggacgcacgaucaaugagacaagcagacucggcuaugagaccuuuaaggugauugaaggguggucuaaccccaaauccaagcugcagaucaaucggcaggucaucguggaccgcagcgauagaucuggauacuccggcauuuucagcgucgagggcaaauccuguaucaaccggugcuuuuauguggaacugauuagagggcgcaaggaggaaaccgagguucucuggacaucuaauagcaucguggucuucuguggaaccuccggcacauacgggacgggaucuuggccugacggcgcugaucugaaccuuaugcccauuuga

SEQ ID NO: 206051 - RNA, 1410 nt, Artificial Sequence; identical to SEQ ID NO: 205946
  derived and/or modified sequence opt5 from neuraminidase__InfluenzaA__AFN19604

SEQ ID NO: 206052 - RNA, 1410 nt, Artificial Sequence; identical to SEQ ID NO: 205946
  derived and/or modified sequence opt5 from neuraminidase__InfluenzaA__AFN19606

SEQ ID NO: 206053 - RNA, 1410 nt, Artificial Sequence; identical to SEQ ID NO: 205946
  derived and/or modified sequence opt5 from neuraminidase__InfluenzaA__AFN19608

SEQ ID NO: 206054 - RNA, 1410 nt, Artificial Sequence; identical to SEQ ID NO: 205946
  derived and/or modified sequence opt5 from neuraminidase__InfluenzaA__AFN19610

SEQ ID NO: 206055 - RNA, 1410 nt, Artificial Sequence; identical to SEQ ID NO: 205954
  derived and/or modified sequence opt5 from neuraminidase__InfluenzaA__AFN19612

SEQ ID NO: 206056 - RNA, 1410 nt, Artificial Sequence; identical to SEQ ID NO: 205170
  derived and/or modified sequence opt5 from neuraminidase__InfluenzaA__AFN19614

SEQ ID NO: 206057 - RNA, 1410 nt, Artificial Sequence
  derived and/or modified sequence opt5 from neuraminidase__InfluenzaA__AFN19618
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaacgagauccuucgcacccaggaaucugagugugugugcauuaacggaacauguacgguggucaugaccgauggcuccgcuagcgggaaagccgacacaaagauccuguuuaucgaggaaggaaaaauuguucauaccuccacacucucuggcagcgcgcaacacguggaggaaugcuccugcuaucccagauacccuggggugcggugugucugccgcgauaauuggaagggaagcaacagacccaucguggacauuaauaucaaggaucacucuauuguuuccagcuacguguguucuggccuggucggcgacaccccgcggaaaaacgacagcuccucuagcucccauugccuugauccuaauaacgaggaagggggacacggcgugaaggggugggccuucgacgauggaaaugacguuuggaugggccgcacgaucaacgagacaagcagacugggguaugagaccuuuaaagugaucgaaggauggucuaaucccaaguccaaacuccagauuaaccggcaggucaucguggaucgcggcgacagaagcggcuacucugggauuuucuccgucgagggaaagagcuguaucaaucggugcuuuuauguggaacugauuagaggccgcaaagaggaaaccgagguucuguggacauccaacucuaucguggucuucugugggaccagcggaacauacggcacgggguccuggccugauggcgcugaccucaaucugaugcccauuuga

SEQ ID NO: 206058 - RNA, 1410 nt, Artificial Sequence; identical to SEQ ID NO: 205946
  derived and/or modified sequence opt5 from neuraminidase__InfluenzaA__AFN19620

SEQ ID NO: 206059 - RNA, 1410 nt, Artificial Sequence; identical to SEQ ID NO: 205982
  derived and/or modified sequence opt5 from neuraminidase__InfluenzaA__AFN19624

SEQ ID NO: 206060 - RNA, 1410 nt, Artificial Sequence; identical to SEQ ID NO: 205946
  derived and/or modified sequence opt5 from neuraminidase__InfluenzaA__AFN19630

SEQ ID NO: 206061 - RNA, 1410 nt, Artificial Sequence
  derived and/or modified sequence opt5 from neuraminidase__InfluenzaA__AFN19632
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccaccgaguaccggaauugguccaagccucagugugacauuacaggguucgcucccuuuucuaaagauaacagcauccgccucuccgccggaggcgacaucugggugaccagagagccuuaugucucuugcgauccggacaaguguuaccaauucgcgcuggggcagggaacaacccuuaauaacgugcauagcaauaacacgguucgggaucgcacacccuauagaacccugcucaugaaugaacugggcgugccuuuucaccuggggacaaagcaggucugcauugcuugguccucuagcuccugucaugacggaaaagccuggcuccacgugugcaucaccggcgaugacaagaacgccaccgcuagcuucauuuacaauggccggcugguugauucuguggucuccuggagcaaagagauccuucgcacacaggaaucugagugugugugcauuaacgggacguguaccguggucaugacagacggauccgccagcggcaaggcugauaccaaaauccuguuuaucgaggaagggaagauuguucauacauccacccucucuggaagcgcccaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacacgccgcggaagaaugauagcuccucuagcucccauugccuugacccuaacaaugaggaaggcgggcacggagugaaaggcugggcguucgaugacgggaacgauguuuggaugggacgcacaaucaaugagaccagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaacagagguucuguggaccuccaauucuaucguggucuucuguggcacaagcgggacguacggaaccggcuccuggccugacggggccgaucucaaccugaugcccauuuga

SEQ ID NO: 206062 - RNA, 1410 nt, Artificial Sequence
  derived and/or modified sequence opt5 from neuraminidase__InfluenzaA__AFN19634
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacguccuauagaacacugcucaugaaugaacugggcgugcccuuucaccuggggaccaagcaggucugcauugccuggucuagcuccagcugucaugacggaaaagccuggcuccacgugugcaucacaggcgaugacaagaacgcuaccgccucuuucauuuacaauggccggcugguugauuccguggucagcuggucuaaagagauccuucgcacccaggaauccgagugugugugcauuaacgggacauguacgguggucaugaccgacggaagcgcuuccggcaaggccgauacaaaaauccuguuuaucgaggaagggaagauuguucauaccucuacacucagcggauccgcgcaacacguggaggaaugcagcugcuauccuagauaccccggcgugcggugugucugccgcgacaacuggaaggggucuaauagaccuaucguggauauuaacaucaaagaccacuccauuguuagcucuuacguguguagcggacuggucggcgacacgccccggaagaaugauuccucuagcuccagccauugccuugacccgaacaaugaggaaggcgggcacggagugaaaggcugggccuucgaugacgggaacgauguuuggaugggacgcaccaucaaugagacaucuagacugggcuaugagaccuuuaaggugaucgaagggugguccaacccuaaaagcaagcuccagauuaaucggcaggucaucguggaccgcggagauagaucuggcuacuccggcauuuucagcgucgaggggaaauccuguaucaaccggugcuuuuauguggaacugauuagaggacgcaaggaggaaaccgagguucuguggacaucuaauagcaucguggucuucuguggcaccuccgggacauacggaacgggcucuuggcccgacggggcugaucucaaccugaugccuauuuga

SEQ ID NO: 206063 - RNA, 1410 nt, Artificial Sequence
  derived and/or modified sequence opt5 from neuraminidase__InfluenzaA__AFN19636
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccauuaucgagaaggaaauuugcccuaaacccacggaguaccggaauugguccaagccucagugugacaucaccggguucgcucccuuuucuaaagauaacagcauccgccucuccgccggaggcgacauuugggugacaagagagccuuaugucucuugcgauccggacaaguguuaccaauucgcgcuggggcagggaaccacacuuaauaacgugcauagcaauaacaccguucgggaucgcacgcccuauagaacacugcucaugaaugaacugggcgugccuuuucaccuggggaccaagcaggucugcaucgcuugguccucuagcuccugucaugacggaaaagccuggcuccacgugugcauuacaggcgaugacaagaacgccaccgcuagcuucaucuacaauggccggcugguugauucuguggucuccuggagcaaagagauucuucgcacccaggaaucugagugugugugcaucaacgggacauguacgguggucaugaccgacggauccgccagcggcaaggcugauacaaaaauccuguuuauugaggaagggaagaucguucauaccuccacacucucuggaagcgcccaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggcguucgaugacgggaacgauguuuggaugggacgcacgaucaaugagacaagcagacugggcuaugagaccuuuaaggugauugaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaaccgagguucuguggacauccaauucuauuguggucuucuguggcaccagcgggacauacggaacgggcuccuggccugacggggccgaucucaaccugaugcccaucuga

SEQ ID NO: 206064 - RNA, 1410 nt, Artificial Sequence; identical to SEQ ID NO: 206063
  derived and/or modified sequence opt5 from neuraminidase__InfluenzaA__AFN19638

SEQ ID NO: 206065 - RNA, 1410 nt, Artificial Sequence; identical to SEQ ID NO: 205946
  derived and/or modified sequence opt5 from neuraminidase__InfluenzaA__AFN19640

SEQ ID NO: 206066 - RNA, 1410 nt, Artificial Sequence
  derived and/or modified sequence opt5 from neuraminidase__InfluenzaA__AFN19642
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguuuccgaucggacgcccuaucgcacacugcucaugaaugaacugggcgugccuuuucaccuggggaccaagcaggucugcaucgccuggucuagcuccagcugucaugacggaaaagccuggcuccacgugugcauuacaggcgaugacaagaacgcuaccgccucuuucaucuacaauggcagacugguugauuccguggucagcuggucuaaagagauucuucggacccaggaauccgagugugugugcaucaacgggacauguacgguggucaugaccgacggaagcgcuuccggcaaggccgauacaaaaauucuguuuaucgaggaagggaagaucguucauaccucuacacucagcggauccgcgcaacacguggaggaaugcagcugcuauccccgcuacccuggcgugagaugugucugccgggacaacuggaaggggucuaaucgccccauuguggauaucaacauuaaagaccacuccaucguuagcucuuacguguguagcggacuggucggcgacaccccgagaaagaaugauuccucuagcuccagccauugccuugacccuaacaaugaggaaggcgggcacggagugaaaggcugggccuucgaugacgggaacgauguuuggaugggacggacgauuaaugagacaucucgccugggcuaugagaccuuuaaggugaucgaagggugguccaaccccaaaagcaagcuccagaucaauagacaggucauuguggaccggucugaucgcuccggauacagcggcaucuucuccgucgagggcaaaucuuguauuaacagaugcuuuuauguggaacugauccgggggagaaaggaggaaaccgagguucuguggacaagcaauuccauuguggucuucuguggaaccucuggcacauacgggacgggaagcuggccugacggcgcugaucucaaccugaugcccaucuga

SEQ ID NO: 206067 - RNA, 1410 nt, Artificial Sequence; identical to SEQ ID NO: 206063
  derived and/or modified sequence opt5 from neuraminidase__InfluenzaA__AFN19644

SEQ ID NO: 206068 - RNA, 1410 nt, Artificial Sequence
  derived and/or modified sequence opt5 from neuraminidase__InfluenzaA__AFN19646
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacccgcugaguaccggaauugguccaagccucagugugacaucaccggguucgcccccuuuucuaaagauaacagcauccgccucuccgcgggaggcgacauuugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauccuguuuauugaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugauugaaggguggucuaaccccaaauccaagcuccagaucaaucggcaggucauugugaaccgcagcgacagaucuggauacuccggcaucuucagcgucgagggcaaauccuguauuaaucggugcuuuuauguggaacugaucagagggcgcaaggaggaaaccgagguucuguggacaucuaacagcauuguggucuucuguggaaccuccggcacauacgggacgggaucuuggccugauggcgcugaccucaaucugaugcccaucuga

SEQ ID NO: 206069 - RNA, 1410 nt, Artificial Sequence; identical to SEQ ID NO: 205946
  derived and/or modified sequence opt5 from neuraminidase__InfluenzaA__AFN19648

SEQ ID NO: 206070 - RNA, 1410 nt, Artificial Sequence; identical to SEQ ID NO: 205982
  derived and/or modified sequence opt5 from neuraminidase__InfluenzaA__AFN19650

SEQ ID NO: 206071 - RNA, 1410 nt, Artificial Sequence
  derived and/or modified sequence opt5 from neuraminidase__InfluenzaA__AFN19652
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaagugguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcaucgccugguccucuagcuccugucaugacggaaaggccuggcuccacguuugcauuacaggcgaugacaagaacgcuaccgccagcuucaucuacaauggccggcugguggauucugucguguccuggagcaaagagauucuucgcacccaggaaucugagugugugugcaucaacgggacauguacggucguuaugaccgacggauccgcuagcggcaaggccgauacaaaaauucuguuuaucgaggaagggaagaucgugcauaccuccacacucucuggaagcgcgcaacacguggaggaaugcuccugcuaucccagauacccuggcguccggugugugugccgcgacaacuggaaggggagcaauagacccauuguugauaucaacauuaaagaccacucuaucguguccagcuacgucuguucuggacuggugggcgacaccccgcggaagaaugauagcuccucuagcucccauugccuugacccuaacaaugaggaaggcgggcacggaguuaaaggcugggccuucgaugacgggaacgauguguggaugggacgcacgauuaaugagacaagcagacugggcuaugagaccuuuaaggucaucgaaggguggucuaaccccaaauccaagcuccagaucaaucgccaggugauugucgaccggggagauagaagcggcuacucuggcaucuucuccguggaggggaaaagcuguauuaaccggugcuuuuauguugaacugaucagaggacgcaaggaggaaaccgaggugcuguggacauccaauucuauugucguguucuguggcaccagcgggacauacggaacgggcuccuggccugacggggcugaucucaaccugaugcccaucuga

SEQ ID NO: 206072 - RNA, 1410 nt, Artificial Sequence
  derived and/or modified sequence opt5 from neuraminidase__InfluenzaA__AFN19654
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaccugcccuaaacccacagaguaccggaauugguccaagccucagugugacaucaccggguucgcucccuuuucuaaagauaacagcauucgccucuccgccggaggcgacaucugggugacaagagagccuuaugucucuugcgauccggacaaguguuaccaauucgcgcuggggcagggaaccacgcuuaauaacgugcauagcaauaacacaguucgggaucgcacccccuauagaacacugcucaugaaugaacugggcgugccuuuucaccuggggaccaagcaggucugcaucgcuugguccucuagcuccugucaugacggaaaagccuggcuccacgugugcauuaccggcgaugacaagaacgccacagcuagcuucaucuacaauggccggcugguugauucuguggucuccuggagcaaagagauucuucgcacgcaggaaucugagugugugugcaucaacgggaccuguacaguggucaugaccgacggauccgccagcggcaaggcugauacaaaaauucuguuuaucgaggaagggaagaucguucauaccuccacgcucucuggaagcgcccaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacacaccgcggaagaaugauagcuccucuagcucccauugccuugacccuaacaaugaggaaggcgggcacggagugaaaggcugggcguucgaugacgggaacgauguuuggaugggacgcaccauuaaugagaccagcagacugggcuaugagacauuuaaggugaucgaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaaccgagguucuguggacauccaauucuauuguggucuucuguggcacgagcgggaccuacggaacaggcuccuggccugacggggccgaucucaaccugaugcccaucuga

SEQ ID NO: 206073 - RNA, 1410 nt, Artificial Sequence; identical to SEQ ID NO: 205946
  derived and/or modified sequence opt5 from neuraminidase__InfluenzaA__AFN19656

SEQ ID NO: 206074 - RNA, 1410 nt, Artificial Sequence; identical to SEQ ID NO: 205170
  derived and/or modified sequence opt5 from neuraminidase__InfluenzaA__AFN19658

SEQ ID NO: 206075 - RNA, 1410 nt, Artificial Sequence; identical to SEQ ID NO: 206063
  derived and/or modified sequence opt5 from neuraminidase__InfluenzaA__AFN19660

SEQ ID NO: 206076 - RNA, 1410 nt, Artificial Sequence; identical to SEQ ID NO: 205170
  derived and/or modified sequence opt5 from neuraminidase__InfluenzaA__AFN19662

SEQ ID NO: 206077 - RNA, 1410 nt, Artificial Sequence
  derived and/or modified sequence opt5 from neuraminidase__InfluenzaA__AFN19664
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaauaccauugagaaggaaaucugcccuaaacccgcugaguaccggaacugguccaagccucagugugggauuacgggauucgcccccuuuucuaaagacaauagcauccgccucuccgcgggcggggauaucugggugaccagagagccuuaugucucuugcgacccggauaaguguuaccaauucgcucugggacagggcacaacccuuaacaaugugcauagcaacaauacaguucgggaccgcacccccuauagaacgcugcucaugaacgaacugggggugccuuuucaccugggaacaaagcaggucugcauugccugguccucuagcuccugucaugauggcaaagccuggcuccacgugugcaucaccggcgacgauaagaaugcuacagccagcuucauuuacaacgggcggcugguugacucuguggucuccuggagcaaagagauccuucgcacccaggaaucugagugugugugcauuaacggaaccuguacaguggucaugacggauggcuccgcuagcgggaaggccgacaccaaaauccuguuuaucgaggaaggaaagauuguucauacauccacccucucuggcagcgcgcaacacguggaggaaugcuccugcuaucccagauacccuggggugcggugugucugccgcgauaauuggaagggaagcaacagacccaucguggacauuaauaucaaagaucacucuauuguuuccagcuacguguguucuggccuggucggcgacacaccgcggaagaacgacagcuccucuagcucccauugccuugauccuaauaacgaggaagggggacacggcgugaaagggugggccuucgacgauggaaaugacguuuggaugggccgcaccaucaacgagacgagcagacugggguaugagacauuuaaggugaucgaaggauggucuaaucccaaauccaagcuccagauuaaccggcaggucaucguggaucgcggcgacagaagcggcuacucugggauuuucuccgucgagggaaaaagcuguaucaaucggugcuuuuauguggaacugauuagaggccgcaaggaggaaaccgagguucuguggaccuccaacucuaucguggucuucugugggacaagcggaaccuacggcacaggguccuggccugauggcgcugaccucaaucugaugcccauuuga

SEQ ID NO: 206078 - RNA, 1410 nt, Artificial Sequence
  derived and/or modified sequence opt5 from neuraminidase__InfluenzaA__AFN19666
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcaucgccugguccucuagcuccugucaugacggaaaagccuggcuccacgugugcauuacaggcgaugacaagaacgcuaccgccagcuucaucuacaauggccggcugguugauucuguggucuccuggagcaaagagauucuucgcacccaggaaucugagugugugugcaucaacgggacauguacgguggucaugaccgacggauccgcuagcggcaaggccgauacaaaaauucuguuuaucgaggaagggaagaucguucauaccuccacacucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgauuaaugagacaagcagacugggcuaugagaccuuuaaggugaucgaaggguggucuaaccccaaauccaagcuccagaucaaucggcaggucauugugaaccgcagcgacagaucuggauacuccggcaucuucagcgucgagggcaaauccuguauuaaucggugcuuuuauguggaacugaucagagggcgcaaggaggaaaccgagguucuguggacaucuaacagcauuguggucuucuguggaaccuccggcacauacgggacgggaucuuggccugauggcgcugaccucaaucugaugcccaucuga

SEQ ID NO: 206079 - RNA, 1410 nt, Artificial Sequence
  derived and/or modified sequence opt5 from neuraminidase__InfluenzaA__AFN19668
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaugaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggugacaagagagccuuaugucucuugcgauccggacaaguguuaccaauucgcucuggggcagggaaccacacuuaauaacgaacauagcaauaacaccgugcgggaucgcacgcccuauagaacacugcucaugaaugagcugggcguuccuuuucaccuggggaccaaacaggugugcaucgccugguccucuagcuccugucaugacggaaaggccuggcuccacgucugcauuacaggcgaugacaagaacgcuaccgccagcuucaucuacaauggccggcugguggauucuguuguguccuggagcaaagaaauucuucgcacccaggagucugagugugucugcaucaacgggacauguacgguggugaugaccgacggauccgcuagcggcaaggccgauacaaaaauucuguuuaucgaagaggggaagaucguccauaccuccacacucucuggaagcgcgcaacacguugaagagugcuccugcuaucccagauacccuggcgugcggugugugugccgcgacaacuggaaggggagcaauagacccauugucgauaucaacauuaaagaccacucuaucguguccagcuacguuuguucuggacuggugggcgacaccccgcggaagaaugauagcuccucuagcucccauugccuugacccuaacaaugaagagggcgggcacggagucaaaggcugggccuucgaugacgggaacgauguguggaugggacgcacgauuaaugagacaagcagacugggcuaugaaaccuuuaagguuaucgagggguggucuaaccccaaauccaagcuccagaucaaucgccaggugauugucgaccggagcgauagaucuggauacuccggcaucuucagcguggaaggcaaauccuguauuaaccggugcuuuuaugucgagcugaucagagggcgcaaggaagagaccgaggugcuguggacaucuaauagcauuguuguguucuguggaaccuccggcacauacgggacgggaucuuggccugacggcgcugaucucaaccugaugcccaucuga

SEQ ID NO: 206080 - RNA, 1410 nt, Artificial Sequence; identical to SEQ ID NO: 205982
  derived and/or modified sequence opt5 from neuraminidase__InfluenzaA__AFN19670

SEQ ID NO: 206081 - RNA, 1410 nt, Artificial Sequence; identical to SEQ ID NO: 205170
  derived and/or modified sequence opt5 from neuraminidase__InfluenzaA__AFN19673

SEQ ID NO: 206082 - RNA, 1410 nt, Artificial Sequence; identical to SEQ ID NO: 205946
  derived and/or modified sequence opt5 from neuraminidase__InfluenzaA__AFN19675

SEQ ID NO: 206083 - RNA, 1410 nt, Artificial Sequence
  derived and/or modified sequence opt5 from neuraminidase__InfluenzaA__AFN19677
augaaccccaaucagaagaucauuaccaucggcagcgugucccugacaauuucuaucauuugcuucuuuaugcaaaucgccauccucauuacgaccgucacacugcacuucaaacaguacgaguuuaacagcccuccgaauaaccagguuaugcuuugugaacccaccaucauugagagaaauaucacagaaauuguguaucugaccaacacaaccaucgagaaggaaauuugcccuaaacccgcugaguaccggaauugguccaagccucagugugacaucacgggguucgcccccuuuucuaaagauaacagcauccgccucuccgcgggaggcgacauuugggugaccagagagccuuaugucucuugcgauccggacaaguguuaccaauucgcucuggggcagggaacaacccuuaauaacgugcauagcaauaacacaguucgggaucgcacccccuauagaacgcugcucaugaaugaacugggcgugccuuuucaccuggggacaaagcaggucugcaucgccugguccucuagcuccugucaugacggaaaagccuggcuccacgugugcauuaccggcgaugacaagaacgcuacagccagcuucaucuacaauggccggcugguugauucuguggucuccuggagcaaagagauucuucgcacccaggaaucugagugugugugcaucaacgggaccuguacaguggucaugacggacggauccgcuagcggcaaggccgauaccaaaauccuguuuauugaggaagggaagaucguucauacauccacccucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacacaccgcggaagaaugauagcuccucuagcucccauugccuugacccuaacaaugaggaaggcgggcacggagugaaaggcugggccuucgaugacgggaacgauguuuggaugggacgcaccaucaaugagacgagcagacugggcuaugagacauuuaaggugauugaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaaccgagguucuguggaccuccaauucuauuguggucuucuguggcacaagcgggaccuacggaacaggcuccuggccugacggggcugaucucaaccugaugcccaucuga

SEQ ID NO: 206084 - RNA, 1410 nt, Artificial Sequence; identical to SEQ ID NO: 205982
  derived and/or modified sequence opt5 from neuraminidase__InfluenzaA__AFN19683

SEQ ID NO: 206085 - RNA, 1410 nt, Artificial Sequence; identical to SEQ ID NO: 205946
  derived and/or modified sequence opt5 from neuraminidase__InfluenzaA__AFN19685

SEQ ID NO: 206086 - RNA, 1410 nt, Artificial Sequence; identical to SEQ ID NO: 205946
  derived and/or modified sequence opt5 from neuraminidase__InfluenzaA__AFN19687

SEQ ID NO: 206087 - RNA, 1410 nt, Artificial Sequence; identical to SEQ ID NO: 205946
  derived and/or modified sequence opt5 from neuraminidase__InfluenzaA__AFN19689

SEQ ID NO: 206088 - RNA, 1410 nt, Artificial Sequence; identical to SEQ ID NO: 205170
  derived and/or modified sequence opt5 from neuraminidase__InfluenzaA__AFN19691

SEQ ID NO: 206089 - RNA, 1410 nt, Artificial Sequence
  derived and/or modified sequence opt5 from neuraminidase__InfluenzaA__AFN19693
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacaugugcuguggucaugacggauggauccgccagcggcaaggcggacaccaaaauccucuuuaucgaggaggggaagauuguucauacauccacccugucuggaagcgcccaacacguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacaccccggaagaaugacagcuccucuagcuccaacugccuggauccgaauaacgaagagggcgggcauggagugaaaggcugggcuuucgacgaugggaaugacguuuggaugggacgcaccaucaacgaaacgagcagacucggcuaugagacauuuaaggugaucgagggguggucuaauccuaaauccaagcugcagauuaaccggcaggucaucguggaucgcggaaauagaagcggcuacucuggcauuuucuccgucgaagggaaaaacuguaucaaucggugcuuuuauguggagcugauuagaggacgcaaggaagagaccgaaguucucuggaccagcaacuccaucguggucuucuguggcacaucugggaccuacggaacaggcagcuggcccgacggggccgaucugaaucuuaugccuauuuga

SEQ ID NO: 206090 - RNA, 1410 nt, Artificial Sequence
  derived and/or modified sequence opt5 from neuraminidase__InfluenzaA__AFN19697
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagacccuucgcacacaggaaucugagugugugugcaucaacggaacguguaccguggucaugacagauggcuccgcuagcgggaaggccgacaccaaaauucuguuuaucgaggaaggaaagaucguucauacauccacccucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacacgccgcggaagaaugacagcuccucuagcucccauugccuugauccuaacaaugaggaagggggacacggcgugaaagggugggccuucgacgauggaaacgacguuuggaugggccgcacaauuaaugagaccagcagacugggguaugagaccuuuaaggugaucgaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaacagagguucuguggaccuccaauucuauuguggucuucugugggacaagcggaacguacggcaccggguccuggccugauggcgcugaccucaaccugaugcccaucuga

SEQ ID NO: 206091 - RNA, 1410 nt, Artificial Sequence; identical to SEQ ID NO: 205946
  derived and/or modified sequence opt5 from neuraminidase__InfluenzaA__AFN19699

SEQ ID NO: 206092 - RNA, 1410 nt, Artificial Sequence; identical to SEQ ID NO: 205982
  derived and/or modified sequence opt5 from neuraminidase__InfluenzaA__AFN19701

SEQ ID NO: 206093 - RNA, 1410 nt, Artificial Sequence
  derived and/or modified sequence opt5 from neuraminidase__InfluenzaA__AFN19703
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuugacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 206094 - RNA, 1410 nt, Artificial Sequence; identical to SEQ ID NO: 203281
  derived and/or modified sequence opt5 from neuraminidase__InfluenzaA__AFN19711

SEQ ID NO: 206095 - RNA, 1410 nt, Artificial Sequence
  derived and/or modified sequence opt5 from neuraminidase__InfluenzaA__AFN19721
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguucccccauggaaugccgcaccuuuuuccucacacagggcgcccugcuuaacgacaagcauagcaauggcaccauuaaagauagaucuccuuaucggacgcugauguccugucccaucggggaggugccuagccccuacaacucccgcuuugaaucuguugccuggagcgcuuccgccugccacgacggaauuaacuggcucaccaucggcaucagcgggccugauaauggagcuguggccguccugaaguauaacggcauuaucacagacaccauuaagucuuggagaaauaacauccugcggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucucgaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcugacaggacuugauuguauucgcccuugcuucugggucgaacugaucagaggccggcccaaggagaacacgauuuggaccagcgggucuuccaucagcuuuuguggaguuaauucugacacagugggcugguccuggcccgauggggcugagcucccuuucaccaucgacaaauga

SEQ ID NO: 206096 - RNA, 1410 nt, Artificial Sequence; identical to SEQ ID NO: 204102
  derived and/or modified sequence opt5 from neuraminidase__InfluenzaA__AFN19731

SEQ ID NO: 206097 - RNA, 1410 nt, Artificial Sequence; identical to SEQ ID NO: 203281
  derived and/or modified sequence opt5 from neuraminidase__InfluenzaA__AFN19737

SEQ ID NO: 206098 - RNA, 1410 nt, Artificial Sequence
  derived and/or modified sequence opt5 from neuraminidase__InfluenzaA__AFN19747
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuacccaugaaaauaacacauggguuaaucagaccuacgugaacaucucuaauacaaacuucgcugccgggcagagcguggucuccgugaaacuugcgggaaauucuagccugugcccuguuuccggcugggcuauuuauagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaccggacgcucaugucuugucccaucggggaggugccuucccccuauaacagccgcuuugaauccguugccuggucugcuagcgccugccaugacggaauuaauuggcugaccaucggcaucuccgggccugauaacggagcuguggccguccugaaguacaauggcauuaucacagacaccauuaagagcuggagaaacaauauccuccggacacaagagucugagugugcgugcgugaacggguccuguuucaccgugaugacggauggaccgagcgacggccaggccucuuauaaaauuuuucgcaucgaaaagggcaaaaucgucaagagcguugagaugaaugcucccaacuaccacuaugaagagugcuccuguuacccugauucuagcgagauuacaugcgugugcagagacaauuggcauggggccaaccggcccuggguguccuucaaucagaaccuggaauaccagaucggauauauuuguagcggcaucuuuggggauaauccucgccccaacgacaaaaccggaucuugcggcccggucuccagcaauggggcuaacggagugaagggcuucucuuuuaaguacggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguauuccggcucuuucguccagcaccccgagcuuacaggacuggauuguauccgcccuugcuucuggguggaacucauuagaggccggcccaaagagaacacgaucuggaccagcggguccagcauuucuuuuuguggaguuaauuccgacacagugggcuggagcuggcccgauggggccgagcugccuuucaccaucgacaaguga

SEQ ID NO: 206099 - RNA, 1410 nt, Artificial Sequence; identical to SEQ ID NO: 203281
  derived and/or modified sequence opt5 from neuraminidase__InfluenzaA__AFN19749

SEQ ID NO: 206100 - RNA, 1410 nt, Artificial Sequence; identical to SEQ ID NO: 203281
  derived and/or modified sequence opt5 from neuraminidase__InfluenzaA__AFN19759

SEQ ID NO: 206101 - RNA, 1410 nt, Artificial Sequence
  derived and/or modified sequence opt5 from neuraminidase__InfluenzaA__AFN19769
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguucuccccucgaaugccgcaccuuuuuccugacacagggcgcccuucugaacgacaagcauagcaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauagagcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuaucauuacgaagagugcucuuguuacccugauagcuccgagaucacaugcguuugccgggacaacuggcacggcagcaaucgccccugggugucuuucaaccagaaucuggaauaucagauuggguacaucuguuccggaauuuuuggcgauaacccuagacccaaugacaaaaccgggagcugcggaccggugucuuccaacggcgccaauggggucaagggauucagcuuuaaguauggcaacggcguguggaucgggcggacaaaauccauuucuagccgcaagggauucgagaugaucugggauccuaacggcuggaccgggaccgacaauaacuuuuccaucaaacaagacauuguuggaaucaaugaauggucuggcuacagcggguccuucgugcagcaucccgagcuuacaggccuggauuguauuagaccuugcuucugggucgaacucauccggggacgccccaaggagaacacgauuuggaccagcggcuccuccaucagcuuuugugggguuaauucugacacagugggaugguccuggcccgauggcgcugagcugccuuucaccaucgacaaauga

SEQ ID NO: 206102 - RNA, 1410 nt, Artificial Sequence; identical to SEQ ID NO: 203281
  derived and/or modified sequence opt5 from neuraminidase__InfluenzaA__AFN19783

SEQ ID NO: 206103 - RNA, 1410 nt, Artificial Sequence; identical to SEQ ID NO: 203982
  derived and/or modified sequence opt5 from neuraminidase__InfluenzaA__AFN19793

SEQ ID NO: 206104 - RNA, 1410 nt, Artificial Sequence; identical to SEQ ID NO: 203281
  derived and/or modified sequence opt5 from neuraminidase__InfluenzaA__AFN19807

SEQ ID NO: 206105 - RNA, 1410 nt, Artificial Sequence
  derived and/or modified sequence opt5 from neuraminidase__InfluenzaA__AFN19809
augaaccccaaucagaagaucauuaccaucggcagcgugugcaugauuaucgggauggccaaccugaugcuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgcugccgggcagagcgugauuuccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggucccuucccccuacaacagccgcuuugaauccguggccuggucugcuagcgccugccacgacggaaucaauuggcugacgaucggcauuuccgggccugauaacggagcuguugccgugcugaaguauaauggcaucauuaccgacacaaucaagagcuggagaaacaauauucuccggacccaagagucugagugugcgugcgucaacggguccuguuucacagugaugaccgauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacgugcguuugcagagacaauuggcacggguccaaccggcccugggugagcuucaaucagaaccuggaauaucagauuggauacaucuguucuggcauuuuuggggauaauccucgccccaacgacaaaacaggauccugcggcccggugagcaccaauggggccaacggagucaagggcuucucuuuuaaguauggcaacgggguguggaucggaagaacaaaauccauuagcucccggaauggcuucgagaugaucugggauccuaacggguggaccggaaccgacaauaaguuuucuaucaaacaagacauuguuggcaucaacgaauggagcggguacuccggcucuuucgugcagcaucccgagcuuacaggacuggauuguauucgcccuugcuucugggucgaacucaucagaggccggcccaaggagaauacgauuuggaccagcggguccagcaucucuuuuuguggagugaacuccgacacaguuggcuggagcuggcccgauggggcugagcugccuuucaccaucgacaaauga

SEQ ID NO: 206106 - RNA, 1410 nt, Artificial Sequence; identical to SEQ ID NO: 204104
  derived and/or modified sequence opt5 from neuraminidase__InfluenzaA__AFN19815

SEQ ID NO: 206107 - RNA, 1410 nt, Artificial Sequence
  derived and/or modified sequence opt5 from neuraminidase__InfluenzaA__AFN19833
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggaaaaauaacauccucagaacacaagaguccgagugugcgugcgugaaugggagcuguuucaccauuaugacggauggaccgucugacggccaggccagcuacaagaucuuucggaucgaaaaaggcaagauugugaaauccgucgagaugaacgcucccaauuaucauuacgaagagugcucuuguuacccugauagcuccgagaucacaugcguuugccgcgacaacuggcacgggagcaauagacccugggugucuuucaaccagaaucuggaauaucagauuggauacaucuguuccggcauuuuuggggauaacccucggcccaaugacaagaccggaagcugcggcccggugucuuccaacggggccaauggagucaagggcuucagcuuuaaauauggcaacgggguguggaucggacgcacaaaguccauuucuagcagaaaaggcuucgagaugaucugggauccuaacggguggaccggaaccgacaauaacuuuuccaucaagcaagacauuguuggcaucaaugaauggucuggguacagcggcuccuucgugcagcaucccgagcuuacaggacuggauuguauucggccuugcuucugggucgaacucauccgcggcagacccaaagagaacacgauuuggaccagcgggucuuccaucagcuuuuguggaguuaauucugacacagugggcugguccuggcccgauggggcugagcugccuuucaccaucgacaaguga

SEQ ID NO: 206108 - RNA, 1410 nt, Artificial Sequence; identical to SEQ ID NO: 203740
  derived and/or modified sequence opt5 from neuraminidase__InfluenzaA__AFN19851

SEQ ID NO: 206109 - RNA, 1410 nt, Artificial Sequence; identical to SEQ ID NO: 203281
  derived and/or modified sequence opt5 from neuraminidase__InfluenzaA__AFN19857

SEQ ID NO: 206110 - RNA, 1410 nt, Artificial Sequence
  derived and/or modified sequence opt5 from neuraminidase__InfluenzaA__AFN19867
augaaccccaaucagaagaucauuaccaucggcagcgugugcaugacaauugggauggccaaccugauccuccaaauuggaaauaucaucuccauuuggaucucucacagcauucagaucggcaaccagaaucagauugagacguguaaccaauccgucaucaccuacgaaaauaacacauggguuaaucagaccuaugugaacauuucuaauacaaacuucgcugccgggcagagcguggucuccgugaaacuggcgggaaauucuagccuuugcccuguuuccggcugggcuaucuacagcaaggacaacucuaucagaauuggguccaaaggagauguguuugucauccgggagccguucauuagcuguucuccccuggaaugccgcaccuuuuuccucacacagggcgcccugcuuaaugacaagcauuccaacggcaccaucaaagauagaagcccuuaucggacgcugaugucuugucccauuggggaggugccuucccccuacaacagccgcuuugaauccguugccuggucugcuagcgccugccacgacggaaucaauuggcucaccaucggcauuuccgggccugauaacggagcuguggccguccugaaguauaauggcaucauuacagacaccaucaagagcuggagaaacaauauucugcggacacaagagucugagugugcgugcgugaacggguccuguuucaccaucaucacggauggaccgagcgacggccaggccucuuacaaaauuuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccucgaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcaucuccucucggaagggcuucgagaugauuugggauccuaauggguggaccggaaccgacaacaauuuuagcaucaaacaagacauuguuggcaucaacgaaugguccggguacucuggcagcuucgugcagcaucccgagcugacaggacuugauuguauucgcccuugcuucugggucgaacugaucagaggccggcccaaggagaauacgaucuggaccuccgggagcucuauuuccuuuuguggagugaacagcgacacaguuggcuggucuuggcccgauggggcugagcucccuuucaccaucgacaaauga

SEQ ID NO: 206111 - RNA, 1410 nt, Artificial Sequence; identical to SEQ ID NO: 203733
  derived and/or modified sequence opt5 from neuraminidase__InfluenzaA__AFN19877

SEQ ID NO: 206112 - RNA, 1410 nt, Artificial Sequence; identical to SEQ ID NO: 203281
  derived and/or modified sequence opt5 from neuraminidase__InfluenzaA__AFN19887

SEQ ID NO: 206113 - RNA, 1410 nt, Artificial Sequence
  derived and/or modified sequence opt5 from neuraminidase__InfluenzaA__AFN19897
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccugcaacucccgcuuugaaucuguugccuggagcgcuuccgccugucacgacggaauuaacuggcugaccaucggcaucagcgggccugauaauggagcuguggccguccugaaguacaacggcauuaucacagacaccauuaagucuuggagaaauaacauccuccggacacaagaguccgagugcgcgugugugaaugggagcugcuucaccauuaugacggauggaccgucugacggccaggccagcuauaaaaucuuucgcaucgaaaagggcaaaauugugaaguccgucgagaugaacgcucccaauuaccauuaugaagaguguucuugcuacccugauagcuccgagaucacaugcguuuguagagacaacuggcacgggagcaaucggcccugggugucuuucaaccagaaucuggaauaccagauuggauauaucugcuccggcauuuuuggggauaacccucgccccaaugacaaaaccggaagcuguggcccggugucuuccaacggggccaauggagucaagggcuucagcuuuaaguacggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguauagcggcuccuucgugcagcaucccgagcuuacaggacuggauugcauucgcccuuguuucugggucgaacucaucagaggccggcccaaggagaacacgauuuggaccagcgggucuuccaucagcuuuugcggaguuaauucugacacagugggcugguccuggcccgauggggcugagcugccuuucaccaucgacaaauga

SEQ ID NO: 206114 - RNA, 1410 nt, Artificial Sequence; identical to SEQ ID NO: 203281
  derived and/or modified sequence opt5 from neuraminidase__InfluenzaA__AFN19907

SEQ ID NO: 206115 - RNA, 1410 nt, Artificial Sequence; identical to SEQ ID NO: 203740
  derived and/or modified sequence opt5 from neuraminidase__InfluenzaA__AFN19917

SEQ ID NO: 206116 - RNA, 1410 nt, Artificial Sequence
  derived and/or modified sequence opt5 from neuraminidase__InfluenzaA__AFN19923
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaaacgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaccggaaccgacaacaauuuuagcaucaaacaagacauuguuggcaucaacgaaugguccggguacucuggcagcuucgugcagcaucccgagcuuacaggacuggauuguauucgcccuugcuucugggucgaacucaucagaggccggcccaaggagaauacgauuuggaccuccgggagcucuaucuccuuuuguggagugaacagcgacacaguuggcuggucuuggcccgauggggcugagcugccuuucaccaucgacaaauga

SEQ ID NO: 206117 - RNA, 1410 nt, Artificial Sequence; identical to SEQ ID NO: 203281
  derived and/or modified sequence opt5 from neuraminidase__InfluenzaA__AFN19933

SEQ ID NO: 206118 - RNA, 1410 nt, Artificial Sequence; identical to SEQ ID NO: 203740
  derived and/or modified sequence opt5 from neuraminidase__InfluenzaA__AFN19943

SEQ ID NO: 206119 - RNA, 1410 nt, Artificial Sequence
  derived and/or modified sequence opt5 from neuraminidase__InfluenzaA__AFN19953
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaagagucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuauccggaucggguccaaaggagauguguuugucauucgcgagccguucaucagcuguucuccccucgaaugcagaaccuuuuuccugacacagggcgcccuucugaacgacaagcauuccaauggcaccauuaaagaucggagcccuuaucgcacgcucaugucuugucccaucggggaggugccuucccccuacaacagcagauuugaauccguugccuggucugcuagcgccugccacgacggaauuaacuggcugaccaucggcaucuccgggccugauaauggagcuguggccguccugaaguauaacggcauuaucacagacaccauuaagagcuggcggaauaacauccuccgcacacaagagucugagugugcgugcgugaauggguccuguuucaccauuaugacggauggaccgagcgacggccaggccucuuacaaaaucuuuagaaucgaaaagggcaaaauugucaagagcguggagaugaacgcucccaauuaucauuacgaagagugcuccuguuacccugauucuagcgagaucacaugcguuugccgggacaacuggcacggguccaaucgccccugggugagcuucaaccagaaucuggaauaucagauuggauacaucuguucuggcauuuuuggggauaacccuagacccaaugacaaaaccggauccugcggcccggugagcucuaacggggccaauggagucaagggcuucuccuuuaaguauggcaacgggguguggaucggacggacaaaaagcauuuccucucgcaagggcuucgagaugaucugggauccuaacggguggaccggaaccgacaauaacuuuagcaucaaacaagacauuguugaaaucaaugagugguccggcuacucugggagcuucgugcagcaucccgaacuuacaggccuggauuguauuagaccuugcuucugggucgagcucauccggggacgccccaaggagaacacgauuuggaccuccggcagcucuaucuccuuuuguggggugaauagcgacacaguuggauggucuuggcccgauggcgcugaacugccuuucaccaucgacaaauga

SEQ ID NO: 206120 - RNA, 1410 nt, Artificial Sequence
  derived and/or modified sequence opt5 from neuraminidase__InfluenzaA__AFN19967
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagauccaauauccuccggacacaagagagcgagugugcgugcgugaacgggucuuguuucaccauuaugacggauggaccgagcgacggccaggccuccuacaaaaucuuucgcaucgaaaagggcaaaauugugaagucugucgagaugaaugcucccaacuaucauuacgaagagugcagcuguuacccugauuccagcgagaucacaugcguuugcagagacaauuggcacgggucuaaccggcccuggguguccuucaaucagaaccuggaauaucagauuggauacaucuguagcggcauuuuuggggauaauccucgccccaacgacaaaaccggaucuugcggcccgguguccagcaauggggccaacggagucaagggcuucuccuuuaaguauggcaaugggguguggaucggaagaacaaaaucuauuagcucccggaagggcuucgagaugaucugggauccuaacggguggaccggaaccgacaacaauuuuucuaucaaacaagacauuguuggcaucaacgaauggagcggguacuccggcagcuucgugcagcaucccgagcuuacaggacuggauuguauucgcccuugcuucugggucgaacucaucagaggccggcccaaggagaauacgauuuggaccucuggguccagcaucucuuuuuguggagugaacuccgacacaguuggcuggagcuggcccgauggggcugagcugccuuucaccaucgacaaauga

SEQ ID NO: 206121 - RNA, 1410 nt, Artificial Sequence
  derived and/or modified sequence opt5 from neuraminidase__InfluenzaA__AFN19973
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaucuagcgacggccaggccuccuacaaaaucuuucgcaucgaaaagggcaaaauugugaagucugucgagaugaacgcuccgaauuaucauuacgaagagugcagcuguuaccccgauuccagcgagaucacaugcguuugcagagacaacuggcacgggucuaaucggccuuggguguccuucaaccagaaucuggaauaucagauuggauacaucuguagcggcauuuuuggggauaacccccgcccuaaugacaaaaccggaucuugcggccccguguccagcaacggggccaauggagucaagggcuucuccuuuaaguauggcaacgggguguggaucggaagaacaaaaucuauuagcucccggaagggcuucgagaugaucugggauccgaacggguggaccggaaccgacaauaacuuuucuaucaaacaagacauuguuggcaucaaugaauggagcggguacuccggcagcuucgugcagcauccugagcuuacaggacuggauuguauucgccccugcuucugggucgaacucaucagaggccggccuaaggagaacacgauuuggaccucuggguccagcaucucuuuuuguggaguuaauuccgacacagugggcuggagcuggcccgauggggcugagcugcccuucaccaucgacaaauga

SEQ ID NO: 206122 - RNA, 1410 nt, Artificial Sequence; identical to SEQ ID NO: 203281
  derived and/or modified sequence opt5 from neuraminidase__InfluenzaA__AFN19979

SEQ ID NO: 206123 - RNA, 1410 nt, Artificial Sequence
  derived and/or modified sequence opt5 from neuraminidase__InfluenzaA__AFN19985
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccguuucuagccggaagggcuucgagaugauuugggauccuaacggguggaccggaaccgacaauaacuuuuccaucaaacaagacaucgugggcauuaaugaauggucuggguacagcggcuccuucguccagcaucccgagcuuacaggacuggauuguauccgcccuugcuucuggguggaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 206124 - RNA, 1410 nt, Artificial Sequence
  derived and/or modified sequence opt5 from neuraminidase__InfluenzaA__AFN19995
augaaccccaaucagaagaucauuaccaucggcagcgugugcaugacaauugggauggccaaccugauccuccaaauuggaaauaucaucuccauuuggaucucucacagcauucagcugggcaaccagucccagacggagaccuguaaucaaucugucaucacauacgaaaacaauaccuggguuaaccagacauaugugaauauuagcaacaccaauuucgcugccgggcaguccguggucucugugaaacuugcgggaaacagcucccugugcccuguuagcggcugggcuaucuacucuaaggacaauuccauuagaaucgggagcaaaggagauguguuugucauccgggagccguucauuucuuguagcccccucgaaugccgcacauuuuuccugacccagggcgcccuucugaacgacaagcauuccaauggcacgaucaaagauagaucuccuuaucggacccucauguccugucccauuggggaggugccuagccccuacaacucccgcuuugaaucuguugccuggagcgcuuccgccugccacgacggaaucaacuggcugacaauuggcaucagcgggccugauaauggagcuguggccguccugaaguauaacggcaucauuaccgacacaaucaagucuuggagaaauaacauucuccggacccaagaguccgagugugcgugcgugaaugggagcuguuucacgaucaugacagauggaccgucugacggccaggccagcuacaaaauuuuucgcaucgaaaagggcaaaaucgugaaguccgucgagaugaacgcucccaauuaucauuacgaagagugcucuuguuacccugauagcuccgagauuaccugcguuugcagagacaacuggcacgggagcaaucggcccugggugucuuucaaccagaaucuggaauaucagaucggauacauuuguuccggcaucuuuggggauaacccucgccccaaugacaaaacaggaagcugcggcccggugucuuccaacggggccaauggagucaagggcuucagcuuuaaguauggcaacgggguguggauuggaagaaccaaauccaucucuagccggaagggcuucgagaugauuugggauccuaacggguggaccggaacagacaauaacuuuuccaucaaacaagacaucguuggcauuaaugaauggucuggguacagcggcuccuucgugcagcaucccgagcuuacgggacuggauuguauccgcccuugcuucugggucgaacucauuagaggccggcccaaggagaacaccaucuggacaagcgggucuuccauuagcuuuuguggaguuaauucugacaccgugggcugguccuggcccgauggggcugagcugccuuucacaaucgacaaauga

SEQ ID NO: 206125 - RNA, 1410 nt, Artificial Sequence; identical to SEQ ID NO: 203281
  derived and/or modified sequence opt5 from neuraminidase__InfluenzaA__AFN20001

SEQ ID NO: 206126 - RNA, 1410 nt, Artificial Sequence
  derived and/or modified sequence opt5 from neuraminidase__InfluenzaA__AFN20013
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguucuccccucgaaugccgcaccuuuuuccugacacagggcgcccuucugaacgacaagcauagcaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcgauccggugucuuccaacggcgccaauggggucaagggauucagcuuuaaguauggcaacggcguguggaucgggagaacaaaauccauuucuagccggaagggauucgagaugaucugggacccuaacggcuggaccgggaccgacaauaacuuuuccaucaaacaagauauuguuggaaucaaugaauggucuggcuacagcggguccuucgugcagcaucccgagcuuacaggccuggacuguauucgcccuugcuucugggucgaacucaucagaggacggcccaaggagaacacgauuuggaccagcggcuccuccaucagcuuuugugggguuaauucugauacagugggaugguccuggcccgacggcgcugagcugccuuucaccaucgauaaauga

SEQ ID NO: 206127 - RNA, 1410 nt, Artificial Sequence
  derived and/or modified sequence opt5 from neuraminidase__InfluenzaA__AFN20020
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggccuuaaugaauggucuggguacagcggcuccuucgugcagcaucccgagcugacaggacucgauuguauccgcccuugcuucugggucgaacugauuagaggccggcccaaggagaacacgaucuggaccagcgggucuuccauuagcuuuuguggaguuaauucugacacagugggcugguccuggcccgauggggcugagcuuccuuucaccaucgacaaauga

SEQ ID NO: 206128 - RNA, 1410 nt, Artificial Sequence; identical to SEQ ID NO: 203281
  derived and/or modified sequence opt5 from neuraminidase__InfluenzaA__AFN20022

SEQ ID NO: 206129 - RNA, 1410 nt, Artificial Sequence
  derived and/or modified sequence opt5 from neuraminidase__InfluenzaA__AFN20035
augaaccccaaucagaagaucauuaccaucggcagcgugugcaugacaauugggaucgccaaccugauucuccaaaucggaaauaucauuuccaucuggauuucucacagcauccagcugggcaaccagucccagauugagacguguaaucaaucugucaucaccuacgaaaacaauacauggguuaaccagaccuaugugaauauuagcaacacaaauuucgcugccgggcaguccguggucucugugaaacuugcgggaaacagcucccugugcccuguuagcggcugggcuaucuacucuaaggacaauuccaucagaauugggagcaaaggagauguguuugucauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggugccuagccccuacaacucccgcuuugaaucuguugccuggagcgcuuccgccugccacgacggaaucaacuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccaucaugacggauggaccgucugacggccaggccagcuacaaaaucuuucgcauugaaaagggcaaaaucgugaaguccgucgagaugaacgcucccaauuaucauuacgaagagugcucuuguuacccugauagcuccgagauuacaugcguuugcagagacaacuggcacgggagcaaucggcccugggugucuuucaaccagaaucuggaauaucagaucggauacauuuguuccggcaucuuuggggauaacccucgccccaaugacaaaaccggaagcugcggcccggugucuuccaacggggccaauggagucaagggcuucagcuuuaaguauggcaacgggguguggauuggaagaacaaaauccaucucuagccggaagggcuucgagaugaucugggauccuaacggguggaccggaaccgacaauaacuuuuccauuaaacaagacaucguuggcauuaaugaauggucuggguacagcggcuccuucgugcagcaucccgagcuuacaggacuggauuguauccgcccuugcuucugggucgaacucauuagaggccggcccaaggagaacacgaucuggaccagcgggucuuccaucagcuuuuguggaguuaauucugacacagugggcugguccuggcccgauggggcugagcugccuuucaccauugacaaauga

SEQ ID NO: 206130 - RNA, 1410 nt, Artificial Sequence; identical to SEQ ID NO: 203281
  derived and/or modified sequence opt5 from neuraminidase__InfluenzaA__AFN20041

SEQ ID NO: 206131 - RNA, 1410 nt, Artificial Sequence; identical to SEQ ID NO: 203281
  derived and/or modified sequence opt5 from neuraminidase__InfluenzaA__AFN20047

SEQ ID NO: 206132 - RNA, 1410 nt, Artificial Sequence; identical to SEQ ID NO: 204104
  derived and/or modified sequence opt5 from neuraminidase__InfluenzaA__AFN20063

SEQ ID NO: 206133 - RNA, 1410 nt, Artificial Sequence
  derived and/or modified sequence opt5 from neuraminidase__InfluenzaA__AFN20077
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuuaagaucgaaaaaggcaagauugugaaauccgucgagaugaacgcucccaauuaucauuacgaagagugcucuuguuacccugauagcuccgagaucacaugcguuugccgcgacaacuggcacgggagcaauagacccugggugucuuucaaccagaaucuggaauaucagauuggauacaucuguuccggcauuuuuggggauaacccucggcccaaugacaagaccggaagcugcggcccggugucuuccaacggggccaauggagucaagggcuucagcuuuaaauauggcaacgggguguggaucggacgcacaaaguccauuucuagcagaaaaggcuucgagaugaucugggauccuaacggguggaccggaaccgacaauaacuuuuccaucaagcaagacauuguuggcaucaaugaauggucuggguacagcggcuccuucgugcagcaucccgagcuuacaggacuggauuguauucggccuugcuucugggucgaacucauccgcggcagacccaaagagaacacgauuuggaccagcgggucuuccaucagcuuuuguggaguuaauucugacacagugggcugguccuggcccgauggggcugagcugccuuucaccaucgacaaguga

SEQ ID NO: 206134 - RNA, 1410 nt, Artificial Sequence; identical to SEQ ID NO: 203281
  derived and/or modified sequence opt5 from neuraminidase__InfluenzaA__AFN20083

SEQ ID NO: 206135 - RNA, 1410 nt, Artificial Sequence
  derived and/or modified sequence opt5 from neuraminidase__InfluenzaA__AFN20094
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugugauuaucuacgaaaacaauaccuggguuaaccagacauaugugaauauuagcaacaccaauuucgcugccgggcaguccguggucucugugaaacuugcgggaaacagcucccugugcccuguuagcggcugggcuaucuacucuaaggacaauuccaucagaauugggagcaaaggagauguguuugucauccgggagccguucauuucuuguagcccccucgaaugccgcacauuuuuccugacccagggcgcccuucugaacgacaagcauuccaauggcacaaucaaagauagaucuccuuaucggacccucauguccugucccauuggggaggugccuagccccuacaacucccgcuuugaaucuguugccuggagcgcuuccgccugccacgacggaaucaacuggcugacgaucggcauuagcgggccugauaauggagcuguggccguccugaaguauaacggcaucauuaccgacacaaucaagucuuggagaaauaacauucuccggacccaagaguccgagugugcgugcgugaaugggagcuguuucacaaucaugaccgauggaccgucugacggccaggccagcuacaaaaucuuucgcauugaaaagggcaaaaucgugaaguccgucgagaugaacgcucccaauuaucauuacgaagagugcucuuguuacccugauagcuccgagauuacgugcguuugcagagacaacuggcacgggagcaaucggcccugggugucuuucaaccagaaucuggaauaucagaucggauacauuuguuccggcaucuuuggggauaacccucgccccaaugacaaagccggaagcugcggcccggugucuuccaacggggcuaauggagucaagggcuucagcuuuaaguauggcaacgggguguggauuggaagaacaaaauccaucucuagccggaagggcuucgagaugaucugggauccuaacggguggaccggaacagacaauaacuuuuccauuaaacaagacaucguuggcauuaaugaauggucuggguacagcggcuccuucgugcagcaucccgagcuuaccggacuggauuguauccgcccuugcuucugggucgaacucauuagaggccggcccaaggagaacaccaucuggacaagcgggucuuccaucagcuuuuguggagucaauucugacacgaugggcugguccuggcccgauggggccgagcugccuuucaccauugacaaauga

SEQ ID NO: 206136 - RNA, 1410 nt, Artificial Sequence; identical to SEQ ID NO: 203740
  derived and/or modified sequence opt5 from neuraminidase__InfluenzaA__AFN20100

SEQ ID NO: 206137 - RNA, 1410 nt, Artificial Sequence
  derived and/or modified sequence opt5 from neuraminidase__InfluenzaA__AFN20114
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcagcccggucucuuccaauggcgccaacggggugaagggauucagcuuuaaauauggcaacggcguuuggauugggcgcacaaaguccaccucuagcagaaauggauucgagaugaucugggauccuaacggcuggaccgggacagacaauuccuuuucuaugaaacaagacauugugggaaucaacgaauggagcggcuacuccgggagcuucguccagcaucccgagcuuacgggccuggauuguauccggccuugcuucuggguggaacucauucgcggaagacccaaggagaauaccguuuggacaucuggcuccagcaucucuuuuuguggggugaacuccgacaccgucggauggagcuggcccgauggcgcugagcugccuuucacaauugacaaauga

SEQ ID NO: 206138 - RNA, 1410 nt, Artificial Sequence
  derived and/or modified sequence opt5 from neuraminidase__InfluenzaA__AFN20128
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuagaucuuggcggaauaacauccuccgcacacaagaguccgagugugcgugcgugaaugggagcuguuucaccauuaugacggauggaccgucugacggccaggccagcuacaagaucuuuagaaucgaaaaaggcaagauuaucaaauccguggagaugaacgcucccaauuaucauuacgaagagugcucuuguuacccugauagcuccgagauuacaugcgucugccgggacaacuggcacgggagcaaucgccccuggguuucuuucaaccagaaucuggaauaucagaucggauacauuuguuccggcaucuuuggggauaacccuagaagcaaugacaagaccggaucuugcggccccguguccagcaacggggccaauggagugaaaggcuucuccuuuaaguauggcaacggggucuggauuggacggacaaagucuaucagcucccgcaaaggcuucgagaugaucugggauccgaacggguggaccggaaccgacaauaacuuuucuauuaagcaagacaucgugggcauuaaugaauggagcggguacuccggcagcuucguucagcauccugagcuuacaggacuggauuguaucagacccugcuucuggguggaacucauucggggccgcccuaaagagaacacgaucuggaccucuggguccagcaucucuuuuuguggagucaauuccgacacagugggcuggagcuggcccgauggggcugagcugcccuucaccauugacaaguga

SEQ ID NO: 206139 - RNA, 1410 nt, Artificial Sequence; identical to SEQ ID NO: 203281
  derived and/or modified sequence opt5 from neuraminidase__InfluenzaA__AFN87935

SEQ ID NO: 206140 - RNA, 1410 nt, Artificial Sequence
  derived and/or modified sequence opt5 from neuraminidase__InfluenzaA__AFN87937
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaccuccucuagaaauggcuucgagaugaucugggauccuaacggguggaccggaacagacaauagcuuuuccaugaaacaagacauugugggcaucaacgaauggucuggguacagcggcuccuucguccagcaucccgagcuuacgggacuggauuguauccggccuugcuucuggguggaacucauucgcggcagacccaaggagaauaccguuuggacaagcgggucuuccaucagcuuuuguggagugaacucugacaccgucggcugguccuggcccgauggggcugagcugccuuucacaauugacaaauga

SEQ ID NO: 206141 - RNA, 1410 nt, Artificial Sequence
  derived and/or modified sequence opt5 from neuraminidase__InfluenzaA__AFN87940
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaccuccucuagaaauggcuucgagaugaucugggauccuaacggguggaccggaacagacaauagcuuuuccauuaaacaagacaucgugggcaucaacgaauggucuggguacagcggcuccuucguccagcaucccgagcuuacgggacuggauuguauucggccuugcuucuggguggaacucauccgcggcagacccaaggagaauaccauuuggacaagcgggucuuccaucagcuuuuguggaguuaacucugacaccgugggcugguccuggcccgauggggcugagcugccuuucacaauugacaaauga

SEQ ID NO: 206142 - RNA, 1410 nt, Artificial Sequence; identical to SEQ ID NO: 199762
  derived and/or modified sequence opt5 from neuraminidase__InfluenzaA__AFN87942

SEQ ID NO: 206143 - RNA, 1410 nt, Artificial Sequence; identical to SEQ ID NO: 206140
  derived and/or modified sequence opt5 from neuraminidase__InfluenzaA__AFN87944

SEQ ID NO: 206144 - RNA, 1410 nt, Artificial Sequence
  derived and/or modified sequence opt5 from neuraminidase__InfluenzaA__AFN87946
augaaccccaaucagaagaucauuaccaucggcagcgugugcaugacaauugggauggccaaccugacgcuccaaaucggaaauauuaucuccaucuggauuucucacagcauccagcugggcaaccagaaucagauugagaccuguaaccaauccgucaucaauuacgaaaacaauacauggguuaaccagaccuaugugaauauuucuaacacaaauuucgcugccgggcagagcguggucuccgugaaacuugcgggaaacucuagccugugcccuguuuccggcugggcuaucuacagcaaggacaauucuauuagaaucggguccaaaggagauguguuugucauccgggagccguucgugagcuguucuccccucgaaugccgcaccuuuuuccugacacagggcgcccuucugaacgacaagcauuccaacggcaccauuaaagauagaagcccuuaucggacgcucaugucuugucccaucggggagguuccuucccccuacaauagccgcuuugaauccguggccuggucugcuagcgccugccacgacggaauuaacuggcugaccaucggcauuuccgggccugauaauggagcugucgccgugcugaaguauaacggcaucaucacagacaccauuaagagcuggagaaauaacauccuccggacacaagagucugagugugcgugcgugaauggguccuguuucaccgucaugacggauggaccgagcgacggccaggccucuuacaaaauuuuucgcaucgaaaagggcaaaauuguuaagagcguggagaugaacgcucccaauuaucauuacgaagagugcuccuguuacccugauucuagcgaggugacaugcgucugcagagacaacuggcacggguccaaucggcccugggugagcuucaaccagaaucuggaauaucagaucggauacaucuguucuggcauuuuuggggauaacccucgccccaaugacaaaaccggauccugcggcccgguuagcucuaacggggccaacggagugaagggcuucuccuuuaaguauggcaauggggucuggaucggaagaacaaaaagcauuuccucucggaacggcuucgagaugaucugggauccuaauggguggaccggaaccgacaacaauuuuagcauuaagcaagacaucgugggcauuaacgaaugguccggguacucuggcagcuucguucagcaucccgagcuuacaggacuggauuguauccgcccuugcuucuggguggaacucaucagaggccggcccaaagagaauacgauuuggaccuccgggagcucuaucuccuuuuguggagucaacagcgacacagugggcuggucuuggcccgauggggcugagcugccuuucaccauugacaaguga

SEQ ID NO: 206145 - RNA, 1410 nt, Artificial Sequence
  derived and/or modified sequence opt5 from neuraminidase__InfluenzaA__AFN87948
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaccuccucuagaaauggcuucgagaugaucugggauccuaacggguggaccggaacagacaauagcuuuuccauuaaacaagacaucgugggcaucaacgaauggucuggguacagcggcuccuucguccagcaucccgagcuuacgggacuggauuguauucggccuugcuucuggguggaacucauccgcggcagacccaaggagaauaccauuuggacaagcgggucuuccaucagcuuuuguggaguuaacucugacauugugggcugguccuggcccgauggggcugagcugccuuucaccaucgacaaauga

SEQ ID NO: 206146 - RNA, 1410 nt, Artificial Sequence
  derived and/or modified sequence opt5 from neuraminidase__InfluenzaA__AFN87950
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucugaaauaucagaucggauacauuuguuccggcaucuuuggggauaacccucgccccaaugacaagaccggaagcugcggcccggucucuuccaacggggccaauggagugaagggcuucagcuuuaaauauggcaacgggguuuggauuggaagaacaaaguccaucucuagccggaaaggcuucgaaaugauuugggauccuaacggguggaccggaaccgacaauaacuuuuccaucaagcaagacaucauuggcaucaaugaguggucuggguacagcggcuccuucgugcagcaucccgaacuuacaggacuggauuguauucgcccuugcuucugggucgagcucaucagaggccggcccaaagaaaacacgauuuggaccagcgggucuuccaucagcuuuuguggaguuaauucugacacagugggcugguccuggcccgauggggcugagcugccuuucaccaucgacaaguga

SEQ ID NO: 206147 - RNA, 1410 nt, Artificial Sequence; identical to SEQ ID NO: 203733
  derived and/or modified sequence opt5 from neuraminidase__InfluenzaA__AFN87952

SEQ ID NO: 206148 - RNA, 1410 nt, Artificial Sequence
  derived and/or modified sequence opt5 from neuraminidase__InfluenzaA__AFN87954
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaagggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacaaugggcuggucuuggcccgauggggcugagcugccuuucaccaucgacaaauga

SEQ ID NO: 206149 - RNA, 1410 nt, Artificial Sequence
  derived and/or modified sequence opt5 from neuraminidase__InfluenzaA__AFN87956
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuuguuggaaacagcucccugugcccugugagcggcugggcgauuuacucuaaggacaauuccaucagaaucgggagcaaaggagaugucuuugugauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggagguuccuagccccuacaacucccgcuuugaaucuguggcuuggagcgccuccgcuugccacgacggaauuaacuggcugaccaucggcaucagcgggccugauaauggagccgucgcugugcugaaguauaacggcauuaucacagacaccauuaagucuuggagaaauaacauccuccggacacaagaguccgagugugccugcgugaaugggagcuguuucaccauuaugacggauggaccgucugacggccaggcgagcuacaaaaucuuucgcaucgaaaagggcaaaauugucaaguccguugagaugaacgcccccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggcuaauggagugaagggcuucagcuuuaaguauggcaacgggguuuggaucggaagaacaaaauccauuucuagccggaagggcuucgagaugaucugggauccuaacggguggaccggaaccgacaauaacuuuuccaucaaacaagacauugugggcacaaaugaauggucuggguacagcggcuccuucguccagcaucccgagcuuacgggacuggauuguauccgcccuugcuucuggguggaacucauuagaggccggcccaaggagaacaccaucuggacaagcgggucuuccauuagcuuuuguggaguuaauucugacaccgugggcugguccuggcccgauggggccgagcugccuuucacaaucgacaacuga

SEQ ID NO: 206150 - RNA, 1410 nt, Artificial Sequence
  derived and/or modified sequence opt5 from neuraminidase__InfluenzaA__AFN87958
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggccagcucuaauggggcuaacggagucaagggcuucuccuuuaaauauggcaacgggguguggauuggacgcacaaagagcaccuccucuagaaauggcuucgagaugaucugggauccuaacggguggaccggaacagacaauagcuuuuccaugaaacaagacauuguuggcaucaacgaauggucuggguacagcggcuccuucgugcagcaucccgagcuuacgggacuggauuguauccggccuugcuucugggucgaacucauucgcggcagacccaaggagaauaccguguggacaagcgggucuuccaucagcuuuuguggaguuaacucugacaccgugggcugguccuggcccgauggggccgagcugccuuucacaauugacaaauga

SEQ ID NO: 206151 - RNA, 1410 nt, Artificial Sequence
  derived and/or modified sequence opt5 from neuraminidase__InfluenzaA__AFN87960
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucuggaucgaacucauuagaggccggcccaaggagaacacgaucuggaccagcgggucuuccaucagcuuuuguggagucaauucugacacagugggcugguccuggcccgauggggcugagcugccuuucaccauugacaaauga

SEQ ID NO: 206152 - RNA, 1413 nt, Artificial Sequence
  derived and/or modified sequence opt5 from neuraminidase__InfluenzaA__AFO64805
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccaacaauggggcugccucuuacaaaaucuucaagauugaaaagggaaaagucacaaagagcaucgagcugaacgcuccuaauucccacuaugaagaguguucuugcuacccggacaccggcaccgugaugugugugugccgcgauaacuggcacgggagcaauagacccugggucuccuuuaaccagaaucuugacuaccagauuggauauaucugcagcggcguuuucggggauaacccucggcccaaagacggagagggcucuuguaauccugugacaguggauggcgccgacggggucaagggauuuuccuacaaauauggcaacgggguguggauuggacgcacgaaguccaauagacugcggaaaggcuucgaaaugaucugggaccccaacggguggaccgauacagacucugauuuuuccguuaagcaagacguggucgcgauuaccgauuggagcggcuacuccggaucuuucgugcagcauccggagcucacaggccuggacugcauccgcccuuguuuuuggguugaacuugugagagggcugccccgggagaauaccacgaucuggacaagcggauccucuauuagcuucugcggcgucaacuccgauaccgccaacuggagcuggccugacggggcugaacuccccuucaccaucgauaaguga

SEQ ID NO: 206153 - RNA, 1413 nt, Artificial Sequence
  derived and/or modified sequence opt5 from neuraminidase__InfluenzaA__AFO64816
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucgcccuggcgggcaauucuagccuuugcccuauuuccgggugggcuaucuauagcaaagauaacucuauucggaucggauccaagggcgacguguucguuauucgcgaaccguuuaucagcuguucucaucuggagugcagaaccuucuuucucacgcagggcgcccugcuuaaugauaaacacuccaacgggaccgugaaggaccggagccccuaccgcgcccugaugucuuguccuaucggagaagcucccuccccuuauaauagcagauucgaguccgucgccuggucugcuagcgccugccaugauggcaugggguggcucacaauuggaaucuccggccccgacgauggggcgguggccguucugaaauacaacggaauuaucaccgaaacaauuaagagcuggcggcgcagaauccugcggacccaggagucugagugugugugcgucaacggcuccuguuuuacgaucaugacagacggcccuaauaacgggccggcuagcuauaagauuuucaaaaucgaaaagggaaaagugaccaagucuauugagcucgaugcccccaauagccacuacgaagagugcuccuguuacccugacgcuggcacagugaugugcgucugccgcgauaacuggcaugggucuaauagacccuggguuagcuuuaaccaaaaucuggacuaucagaucggauacauuuguuccggcguguucggggauaacccucggcccaaagacggaaagggcagcugcgacccggugaccgucgauggcgccgacggggugaagggauuuucuuaucgcuacggcaaugggguuuggaucggaagaaccaaauccaacagcucucggcgcggcuucgagaugauuugggauccuaauggguggacagacacggauuccaaguuucuugugaaacaggacgucguggcgaugaccgauuggagcggcuauuccggaucuuucguucagcaccccgaacugacaggccucgacuguaugagaccuugcuuuuggguggagcugauccgggggagaccccgcgaaaacaccacaaucuggaccagcggauccucuauuagcuucuguggcgucaauggggauacggccaacugguccuggcccgacggagcugagcuuccuuucacaaucgauaaguga

SEQ ID NO: 206154 - RNA, 1413 nt, Artificial Sequence
  derived and/or modified sequence opt5 from neuraminidase__InfluenzaA__AFO64827
augaaccccaaucagaagaucauuaccaucggcagcauuuccauggccaucgggauuaucucucugauccuccaaauuggaaacaucauuagcaucugggugucccacucuauucagacaggcagccagaaucauacggggaucugcaaccagagaauuaucaccuacgagaauagcacaugggucaaccaaaccuauguuaauaucaacaauacaaacgugauugcuggaaaagacaagaccucugugacacuggccggcaauagcucccuuuguccuauccgggggugggcgauuuacaccaaagauaacagcauccgcauuggaucuaagggcgacgucuucgugaucagagaaccguuuaucuccugcagccaccuggagugucggacguucuuucucacccagggcgcucugcuuaaugauaaacauucuaacgggacaguuaaggaccgcucccccuauagagcccugaugagcugcccucucggagaagcccccucuccuuacaauucccgguucgagagcguggcuugguccgccucugcuugucacgauggcaugggguggcugaccauuggaaucagcggccccgacgauggggccgucgcggugcugaaguauaacggaauuaucacagaaaccauuaaauccuggaagaaacgcauccucagaacgcaggagagcgagugcguuugugugaacggcucuugcuuuacaaucaugaccgacggcccuuccaauggggccgcuagcuaccggauuuucaagaucgaaaaaggaaaggucacaaagucuauugagcuggaugccccgaacagccauuaugaagaguguuccugcuaccccgacaccggcaccgugaugugugugugccgcgauaauuggcacgggucuaacagaccuugggucagcuuuaaucagaaccuugacuaccaaaucggauauauuugcuccggcguuuucggggauaauccccggccuaaagacggaaagggcagcugugaccccgugacaguggauggcgcugacggggucaaaggauuuucuuaccgcuauggcaacgggguguggaucggaagaacgaaguccaaucgguuccgcaaaggcuuugagaugauuugggauccgaacggguggaccgacacagauagcgacuuccugguuaagcaggauguggucgccaugaccgacuggucuggcuacuccggauccuuugugcagcacccugaacucacaggccuggauugcaugagacccuguuucuggguugagcuugugcgggggagaccucgcgaaaauaccacgaucuggacauccggaucuagcaucuccuucugcggcgucaacucugacaccgcgaauuggagcuggcccgauggggccgagcugcccuuuaccauugacaaauga

SEQ ID NO: 206155 - RNA, 1413 nt, Artificial Sequence
  derived and/or modified sequence opt5 from neuraminidase__InfluenzaA__AFO64838
augaaccccaaucagaagaucauuaccaucggcagcauuuccauggccaucgggauuaucucucugauccuccaaauuggaaacaucauuagcaucugggcuucccacucuauucagacaggcagccagaaucauacggggaucugcaaccagagaauuaucaccuacgagaauagcacaugggugaaccaaaccuaugucaauaucaacaauacaaacguuguggccggaaaagacaagaccucugugacacuggcgggcaauagcucccuuuguccuauucgggggugggcuaucuacaccaaagauaacagcauucgcaucggaucuaagggcgacgucuucgugauuagagaaccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggcaugggguggcugaccaucggaauuagcggccccgacaacggggcggucgccgugcugaaguauaacggaaucauuacagaaaccaucaaauccuggaagaaacgcauucucagaacgcaggagagcgagugcguuugugugaauggcucuugcuuuacaaucaugaccgauggcccuuccaacggggcugccagcuaccggaucuucaagauugaaaaaggacgcgucacaaagucuaucgagcuggacgcuccgaauuaucauuacgaagaguguagcugcuaccccgauaccggcaccgugaugugugugugcagagacaacuggcacggguccaaucggccuugggucucuuuuaaccagaaucuugauuaucaaauuggauacaucugcagcggcguuuucggggacaacccccgcccuaaggauggagagggcuccuguaaucccgugacaguggacggcgccgacggggucaaaggauuuagcuauagauacggcaacgggguguggauuggacggacgaagucuaaucgccugagaaaaggcuucgaaaugaucugggauccgaacggguggaccgacacagauuccgacuuuagcaugaagcaggauguuguggcgaugaccgacuggucuggcuauuccggauccuucguccagcacccugagcucacaggccuggauugcaugcggcccuguuuuuggguggaacuuguuagagggcugccucgcgagaauaccacgauuuggacauccggaucuagcaucuccuucugcggcgugaacucugacaccgccaauuggagcuggcccgauggggcugaacuccccuucaccaucgacaaauga

SEQ ID NO: 206156 - RNA, 1413 nt, Artificial Sequence
  derived and/or modified sequence opt5 from neuraminidase__InfluenzaA__AFO64849
augaaccccaaucagaagaucauuaccaucggcagcauuuccauggccaucgggauuaucucucugauccuccaaauuggaaacaucauuagcaucugggcuucccacucuauucagacaggcagccagaaucauacggggaucugcaaccagagaauuaucaccuacgaaaauuccacaugggugaaccaaaccuaugucaauaucaacaauacaaacguuguggccggaaaagacaagaccucugugacacuggcgggcaauagcucccuuuguccuauucgggggugggcuaucuacaccaaagauaacagcauucgcaucggaucuaagggcgacgucuucgugauuagagagccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggcaugggguggcugaccaucggaauuagcggccccgacaacggggcggucgccgugcugaaguauaacggaaucauuacagaaaccaucaaauccuggaagaaacagauucuccgcacgcaggagagcgagugcguuugugugaauggcucuugcuuuacaaucaugaccgauggcccuuccaacggggcugccagcuacagaaucuucaagauugaaaaaggaaagaucacaaagucuauugagcuggacgcuccgaauagccauuaugaagaguguuccugcuaccccgauaccggcaccgucaugugugugugccgggacaacuggcacgggucuaaucgcccuugggugagcuuuaaccaaaaucuugauuaccagaucggauauauuugcuccggcgucuucggggacaaccccagaccuaaagauggagagggcagcuguaaucccguuacaguggacggcgccgacggggugaagggauuuucuuaccgguauggcaacggggucuggaucggacgcacgaaauccaauagacugcggaagggcuucgaaaugauuugggauccgaacggguggaccgacacagauagcgacuuuucugugaaacaggauguuguggcgaugaccgacugguccggcuacagcggauccuucguccagcacccugagcucacaggccuggauugcaugcgccccuguuuuuggguggaacuuguuagagggcggccuagagagaaugccaccaucuggacgucuggaagcuccaucucuuucugcggcgugaacagcgacacagcuaauugguccuggcccgauggggccgaacugcccuucaccauugacaaguga

SEQ ID NO: 206157 - RNA, 1413 nt, Artificial Sequence; identical to SEQ ID NO: 197992
  derived and/or modified sequence opt5 from neuraminidase__InfluenzaA__AFO64860

SEQ ID NO: 206158 - RNA, 1413 nt, Artificial Sequence
  derived and/or modified sequence opt5 from neuraminidase__InfluenzaA__AFO64871
augaaccccaaucagaagaucauuaccaucggcagcauuuccaucgccauugggaucaucucucugauucuccaaaucggaaacauuaucagcauuugggcuucccacucuauccagacaggcagccagaaucauacgggggugugcaaccagagaauuaucaccuacgagaauagcacaugggucaaccaaaccuauguuaauaucaacaauacaaacgugguggccggaaaagacaagaccucuaugacacuggcgggcaauagcucccuuuguccuauucgggggugggcuaucuacaccaaagauaacagcauucgcaucggaucuaagggcgacgucuucgugauuagagaaccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggccugggguggcugaccaucggaauuagcggccccgacaacggggcggucgccgugcucaaguauaacggaaucauuacagaaaccaucaaauccuggaagaaacgcauucugagaacgcaggagagcgagugcguuuguaugaauggcucuugcuuuacaaucaugaccgauggcccuuccaacggggcugccagcuaccggaucuucaagauugaaaaaggacgcgugacaaagucuaucgagcuugacgcuccgaauuaucauuacgaagaguguagcugcuaccccgauaccggcaccgucaugugugugugcagagacaacuggcacggguccaaucggccuugggugucuuuuaaccagaaucuggauuaucaaauuggauacaucugcagcggcgucuucggggacaacccccgcccuaaggauggagagggcuccuguaaucccguuacaguggacggcgccgacggggugaaaggauuuagcuauagauacggcaacggggucuggauuggacggacgaagucuaaucgccucagaaaaggcuucgaaaugaucugggauccgaacggguggaccgacacagauuccgacuuuagcaugcggcaggauauuguggcgaugaccgacuggucuggcuauuccggauccuucguucagcacccugagcugacaggccuugauugcaugagacccuguuuuuggguggaacugguccgcgggcucccucgggagaauaccacgaucuggacauccggaucuagcaucuccuucugcggcgugaacucugacaccgccaauuggagcuggcccgauggggcugaacugcccuucaccauugacaaguga

SEQ ID NO: 206159 - RNA, 1413 nt, Artificial Sequence
  derived and/or modified sequence opt5 from neuraminidase__InfluenzaA__AFO64882
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacucucacuaugaagaguguagcugcuacccggacaccggcaccgugaugugugugugccgcgauaauuggcacggguccaacagacccugggucagcuuuaaucagaaccuugacuaccagauuggauauaucugcucuggcguuuucggggauaauccucggcccaaagacggagagggcuccuguaacccugugacaguggauggcgccgacggggucaagggauuuagcuacaaauauggcaaugggguguggauuggacgcacgaagucuaacagacugcggaaaggcuucgaaaugaucugggaccccaauggguggaccgauacagacuccgauuuuagcguuaagcaagacguggucgcgauuaccgauugguccggcuacucuggauccuucgugcagcauccggagcucacaggccuggacugcauccgcccuuguuuuuggguugaacuugugagagggcggccccgcgagaacaccacgaucuggacauccggaucuagcauuuccuucugcggcgucaauagcgauaccgccaacuggucuuggccugacggggcugaacugcccuucaccaucgauaaguga

SEQ ID NO: 206160 - RNA, 1413 nt, Artificial Sequence
  derived and/or modified sequence opt5 from neuraminidase__InfluenzaA__AFO64893
augaaccccaaucagaagaucauuaccaucggcagcauuuccguggccaucgggauuaucucucugaugcuccaaaucggaaacauuaucagcauuugggcuucccacucuauccagacaggcagccagaaucauacggggauuugcaaccagagaaucauuaccuacgagaauagcacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagagaauccuccggacgcaggaguccgagugcgugugugucaauggcagcugcuuuacaauuaugaccgauggccccucugacggggcugccagcuacaaaaucuucaagaucgaaaagggaaaagugacaaaguccauugagcugaacgcuccuaauucucacuaugaagaguguagcugcuacccggauaccggcaccgugaugugugucugccgcgacaacuggcacggguccaauagacccuggguuagcuuuaaccagaaucuugauuaccagaucggauauauuugcucuggcguguucggggacaacccucggcccaaagauggagagggcuccuguaauccugugacagucgacggcgccgacggggugaagggauuuagcuacaaauauggcaacgggguuuggaucggacgcacgaagucuaauagauuccggaaaggcuuugaaaugauuugggaucccaacggguggaccgacacagauuccgacuucagcgugaagcaagaugucguggcgaucaccgacugguccggcuacucuggauccuuuguucagcauccggagcugacaggccucgauugcauucgcccuuguuucuggguggaacuggucagagggcggccccgcgagaauaccacgaucuggacauccggaucuagcaucuccuucugcggcgugaacagcgacaccgccaauuggucuuggccugauggggcugaacuucccuuuaccauugacaaguga

SEQ ID NO: 206161 - RNA, 1413 nt, Artificial Sequence
  derived and/or modified sequence opt5 from neuraminidase__InfluenzaA__AFO64904
augaaccccaaucagaagaucauuaccaucggcagcauuuccguggccaucgggauuaucucucugauccuccaaauuggaaacaucauuagcaugugggcuucccacucuauccagacaggcagccagaauuacacggggauuugcaaccagagaaucauuaccuaugagaauaacacaugggugaaucaaaccuacguuaacaucaauaacacaaaugugguggccggaaaagacaagaucuccaugacccuggcgggcaacucuagccuuuguccuauucgggggugggcuaucuauacaaaagauaauuccauucgcaucggaagcaagggcgacgucuucgugauuagagaaccguuuaucucuugcucccaucuggagugucggaccuucuuucucacgcagggcgcccugcuuaacgauaaacacagcaaugggaccguuaaggaccgcucucccuacagagcccugauguccugcccucucggagaagcucccagcccuuauaacucucgguucgaguccguggccuggagcgcuuccgccugucaugauggccugggguggcugacaaucggaauuucuggccccgacaacggggcggucgccgugcucaaguacaauggaaucauuaccgaaacaaucaaaagcuggaagaaacagauucugcgcacccaggaguccgagugcguuugugugaacggcagcugcuuuacgaucaugacagauggcccuucuaauagagcugccuccuaucggaucuucaagauugaaaaagggcgcgucaccaagagcaucgagcuugacgcuccgaacuaccacuacgaagaguguucuugcuaucccgauacaggaaccgugaugugugugugcagagacaauuggcauggcagcaaccggccuugggucuccuuuaaucaaaaccuggauuaccagauuggguauaucugcucuggaguuuucggcgacaauccccgcccuaaggauggggagggaagcuguaaccccgugaccguggacggcgccgacggcgucaaaggguuuuccuacaaguauggaaauggcguguggauugggagaacaaaaagcaaccggcuccgcaagggauucgaaaugaucugggauccgaauggcuggacggacaccgauucugacuuuuccaugaaacaggauguuguggcgaugacagacuggagcggguacucuggcuccuucguccagcacccugagcugaccggacuugauugcaugagacccuguuuuuggguggaacugguucggggccucccuagagagaacacaaccauuuggacgagcggguccucuaucagcuucugcggagucaauuccgaaacagccaacuggucuuggcccgacggcgcugagcugcccuucaccaucgauaaguga

SEQ ID NO: 206162 - RNA, 1413 nt, Artificial Sequence
  derived and/or modified sequence opt5 from neuraminidase__InfluenzaA__AFO65019
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacucucacuaugaagaguguagcugcuacccggacaccggcaccgugaugugugugugccgcgauaauuggcacggguccaacagacccugggucagcuuuaaucagaaccuugacuaccagauuggauauaucugcucuggcguuuucggggauaauccucggcccaaagacggagagggcuccuguaacccugugacagccgauggcgcggacggggugaagggauuuagcuacaaauauggcaauggggucuggauuggacgcacgaagucuaacagacugcggaaaggcuucgaaaugaucugggaccccaauggguggaccgauacagacuccgauuuuagcgugaagcaagacguuguggccauuaccgauugguccggcuacucuggauccuucguccagcauccggagcucacaggccuggacugcauccgcccuuguuuuuggguggaacuuguuagagggcggccccgcgagaacaccacgaucuggacauccggaucuagcauuuccuucugcggcgugaauagcgauaccgcuaacuggucuuggccugacggggccgaacugcccuucaccaucgauaaguga

SEQ ID NO: 206163 - RNA, 1413 nt, Artificial Sequence; identical to SEQ ID NO: 199477
  derived and/or modified sequence opt5 from neuraminidase__InfluenzaA__AFO65030

SEQ ID NO: 206164 - RNA, 1413 nt, Artificial Sequence
  derived and/or modified sequence opt5 from neuraminidase__InfluenzaA__AFO65041
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagcagauccucagaacgcaggaguccgagugcgugugugucaauggcagcugcuuuacaauuaugaccgauggccccucuaacggggcugccagcuacaaaaucuucaagaucgaaaagggaaaagugacaaaguccauugagcugaaugcuccuaacuuucacuaugaagaguguucuugcuacccggacaccggcaccgugaugugugucugccgggauaauuggcacgggagcaaccgccccuggguuuccuucaaucagaaccuugacuaccaaaucggauauauuugcagcggcguguuuggggauaauccuagacccaaagacggagagggcucuuguaacccugugacagucgauggcgccaauggggugaagggauucuccuacaaauauggcaacgggguuuggaucggacggacgaaguccaaucgccugagaaaaggcuuugaaaugauuugggaccccaacggguggaccgacacagauucugacuucuccgugaagcaggaugucguggcgaucaccgacuggagcggcuacuccggaucuuuuguucagcauccggagcucacaggccuggauugcauucggccuuguuucuggguggaacuuguccgcgggcugcccagagagaauaccacgaucuggacaagcggauccucuaucagcuucugcggcgugaacuccgacaccgccaacuggagcuggccugauggggcugaacuccccuuuaccauugacaaguga

SEQ ID NO: 206165 - RNA, 1413 nt, Artificial Sequence
  derived and/or modified sequence opt5 from neuraminidase__InfluenzaA__AFO65052
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucuaugacacuggcgggcaauagcucccuuuguagcauuucugggugggcuaucuacaccaaagauaacuccauucggaucggaagcaagggcgacguguucgucauucgcgaaccuuuuaucucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucuguugccuggagcgcuuccgccuguaacgauggcaugggguggcugaccaucggaauuagcggcccugacaacggggcgguggccguccugaaauauaauggaaucauuacagaaaccaucaagucuuggaaaaagcagauucucagaacgcaggaguccgagugcguguguguuaacggcagcugcuuuacaaucaugaccgauggccccucuaauggggcugccagcuacaaaaucuucaagauugaaaagggaaaagugacaaaguccaucgagcugaacgcuccuaauuuucauuaugaagaguguucuugcuacccggacaccggcaccgucaugugugugugccgggauaacuggcacgggagcaaucgccccuggguguccuucaaccagaaucuugacuaccaaauuggauauaucugcagcggcgucuuuggggauaacccuagacccaaagacggagagggcucuuguaauccuguuacaguggauggcgccaacggggugaagggauucuccuacaaauauggcaauggggucuggauuggacggacgaaguccaaccgccugagaaaaggcuuugaaaugaucugggaccccaauggguggaccgacacagauucugacuucuccgugaagcaggauguuguggcgauuaccgacuggagcggcuacuccggaucuuuuguccagcacccggagcucacaggccuggauugcauccggccuuguuucuggguggaacuuguucgcgggcugcccagagagaacaccacgaucuggacaagcggauccucuauuagcuucugcggcgugaacuccgacaccgccaauuggagcuggccugauggggcugaacuccccuuuaccaucgacaaguga

SEQ ID NO: 206166 - RNA, 1413 nt, Artificial Sequence; identical to SEQ ID NO: 197852
  derived and/or modified sequence opt5 from neuraminidase__InfluenzaA__AFO66139

SEQ ID NO: 206167 - RNA, 1413 nt, Artificial Sequence
  derived and/or modified sequence opt5 from neuraminidase__InfluenzaA__AFO66150
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagagaauuaucaccuaugagaaucggacaugggucaaccaaaccuacguuaauaucaacaauacaaacgugguggccggaaaagacaagaccuccaugacacuggcgggcaauucuagccuuuguccuauucgcgggugggcuaucuauaccaaagauaacuccauuagaaucggaagcaagggcgacgucuucgugauucgggaaccguuuaucucuugcucccaucuggagugucgcacguucuuucucacccagggcgcccugcuuaaugauaaacacagcaacgggacaaucaaggacagaucucccuuccgggcccugauguccugcccucucggagaagcucccagcccuuacaauucucgcuuugaguccguugccuggagcgcuuccgccugucaugauggccugggguggcugaccauuggaaucucuggccccgacaacggggcgguggccguccucaaguauaacggaauuaucacagaaaccauuaaaagcuggaagaaacagauccugagaacgcaggaguccgagugcguguguguuaauggcagcugcuucacaaucaugaccgauggcccuucuaaccgggcugccuccuaccgcauuuuuaagaucgaaaaagggagagugacaaagagcauugagcuugacgcuccgaauuaucacuacgaagaguguucuugcuaccccgauaccggaaccgucaugugugugugccgggacaacuggcauggcagcaaucgcccuuggguguccuucaaccaaaaucuggauuaucagaucggguacauuugcucuggagucuuuggcgacaaccccagaccuaaggauggggagggaagcuguaaucccguuacaguggacggcgccgacggcgugaaaggguucuccuaucgguacggaaacggcgucuggaucgggcgcaccaagagcaaucggauuagaaaaggauuugaaaugaucugggauccgaacggcuggacggacacagauucugacuucuccaugaagcaggaugugguugcgaugaccgacuggagcggguauucuggcuccuuugugcagcacccugagcucacaggacuggauugcaugagacccuguuucugggucgaacuugugcgcggccugccucgggagaauaccacgaucuggacaagcggguccucuauuagcuucugcggaguuaacuccgaaaccgccaauuggucuuggcccgacggcgcugagcuccccuuuaccaucgauaaauga

SEQ ID NO: 206168 - RNA, 1413 nt, Artificial Sequence
  derived and/or modified sequence opt5 from neuraminidase__InfluenzaA__AFO66161
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugauuugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugacaguggauggcgccaauggggucaagggauucuccuacaaauauggcaacgggguguggaucggacggacgaaguccaaucgccugagaaaaggcuuugaaaugauuugggaccccaacggguggaccgacacagauucugacuucuccguuaagcaggauguggucgcgaucaccgacuggagcggcuacuccggaucuuuugugcagcauccggagcucacaggccuggauugcauccggccuuguuucuggguugaacuugugcgcgggcugcccaaggagaauaccacgauuuggacaagcggauccucuaucagcuucugcggcgucaacuccgacaccgccaacuggagcuggccugauggggcugaacuccccuuuaccauugacaaauga

SEQ ID NO: 206169 - RNA, 1413 nt, Artificial Sequence
  derived and/or modified sequence opt5 from neuraminidase__InfluenzaA__AFO66172
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugugaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuuguaugaauggcagcugcuuuacaaucaugaccgauggccccucuaacggggcugccagcuacaaaaucuucaagauugaaaagggaaaagugacaaaguccaucgagcugaaugcuccuaacuuucacuaugaagaguguucuugcuacccggacaccggcaccgucaugugugugugccgcgauaauuggcacgggagcaacagacccuggguguccuucaaucagaaccuugacuaccagauuggauauaucugcagcggcgucuuuggggauaauccucggcccaaagacggagagggcucuuguaacccuguuacaguggauggcgccgacggggugaagggauucuccuacaaauauggcaauggggucuggauuggacgcacgaaguccaacagacugcggaaaggcuuugaaaugaucugggaccccaauggguggaccgauacagacucugauuucuccgugaagcaagacguuguggcgauuaccgauuggagcggcuacuccggaucuuuuguccagcauccggagcucacaggccuggacugcauccgcccuuguuucuggguggaacuuguuagagggcugccccgggagaacaccacgaucuggacaagcggauccucuauuagcuucugcggcgucaauuccgauaccgccaacuggagcuggccugacggggcugaacuccccuuuaccaucgauaaguga

SEQ ID NO: 206170 - RNA, 1413 nt, Artificial Sequence; identical to SEQ ID NO: 197954
  derived and/or modified sequence opt5 from neuraminidase__InfluenzaA__AFO66183

SEQ ID NO: 206171 - RNA, 1413 nt, Artificial Sequence
  derived and/or modified sequence opt5 from neuraminidase__InfluenzaA__AFO66194
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgggauaauuggcacgggagcaaccgccccugggucuccuucaaucagaaccuugacuaccaaauuggauauaucugcagcggcguuuuuggggauaauccuagacccaaagacggagagggcucuuguaacccugugacaguggauggcgccaauggggucaagggauucuccuacaaauauggcaacgggguguggauuggacggacgaaguccaaucgccugagaaaaggcuuugaaaugaucugggaccccaacggguggaccgacacagauucugacuucuccguuaagcaggauauuguggcgaucaccgacuggagcggcuacuccggaucuuuuguccagcauccggagcucacaggccuggauugcauccggccuuguuucuggguggaacuuguucgcgggcugcccaaggagaauaccacgauuuggacaagcggauccucuaucagcuucugcggcgugaacuccgacaccgccaacuggagcuggccugauggggcugaacuccccuuuaccauugacaaauga

SEQ ID NO: 206172 - RNA, 1410 nt, Artificial Sequence; identical to SEQ ID NO: 199579
  derived and/or modified sequence opt5 from neuraminidase__InfluenzaA__AFO66205

SEQ ID NO: 206173 - RNA, 1413 nt, Artificial Sequence; identical to SEQ ID NO: 197439
  derived and/or modified sequence opt5 from neuraminidase__InfluenzaA__AFO66216

SEQ ID NO: 206174 - RNA, 1413 nt, Artificial Sequence; identical to SEQ ID NO: 197410
  derived and/or modified sequence opt5 from neuraminidase__InfluenzaA__AFO66227

SEQ ID NO: 206175 - RNA, 1413 nt, Artificial Sequence
  derived and/or modified sequence opt5 from neuraminidase__InfluenzaA__AFO66238
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuuguaugaauggcagcugcuuuacaaucaugaccgauggccccucuaacggggcugccagcuacaaaaucuucaagauugaaaagggaaaagugacaaaguccaucgagcugaaugcuccuaacuuucacuaugaagaguguucuugcuacccggacaccggcaccgucaugugugugugccgggauaauuggcacgggagcaaccgccccuggguguccuucaaucagaaccuugacuaccaaauuggauauaucugcagcggcgucuuuggggauaauccuagacccaaagacggagagggcucuuguaacccuguuacaguggauggcgccgacggggugaagggauucuccuacaaauauggcaauggggucuggauuggacggacgaaguccaaccgccugagaaaaggcuuugaaaugaucugggaccccaauggguggaccaacacagauucugacuucuccgugaagcaggauguuguggcgauuaccgacuggagcggcuacuccggaucuuuuguccagcauccggagcucacaggccuggauugcauccggccuuguuucuggguggaacuuguucgcgggcugcccagagagaauaccacgaucuggacaagcggauccucuauuagcuucugcggcgugaacuccgacaccgccaacuggagcuggccugauggggcugaacuccccuuuaccaucgacaaguga

SEQ ID NO: 206176 - RNA, 1413 nt, Artificial Sequence
  derived and/or modified sequence opt5 from neuraminidase__InfluenzaA__AFO66249
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacaggcaccaucaagucuuggaaaaagcagauucucagaacgcaggaauccgagugcguuuguaugaauggcagcugcuuuacaaucaugaccgaugggcccucuaacggagcugccagcuacaaaaucuucaagauugagaagggcaaagugacaaaguccaucgaacugaaugcuccuaacuuucacuaugaggaauguucuugcuacccggacaccgggaccgucaugugugugugccgggauaauuggcacggaagcaaccgccccuggguguccuucaaucagaaccuugacuaccaaauuggcuauaucugcagcggggucuuuggagauaauccuagacccaaagacggcgagggcucuuguaacccuguuacaguggauggggccgacggagugaagggcuucuccuacaaauaugggaauggagucuggauuggccggacgaaguccaaccgccugagaaaaggguuugagaugaucugggaccccaauggcuggaccaacacagauucugacuucuccgugaagcaggauguuguggcgauuaccgacuggagcggauacuccggcucuuuuguccagcauccggaacucacagggcuggauugcauccggccuuguuucuggguggagcuuguucgcggacugcccagagaaaauaccacgaucuggacaagcggcuccucuauuagcuucugcggggugaacuccgacaccgccaacuggagcuggccugauggagcugagcuccccuuuaccaucgacaaguga

SEQ ID NO: 206177 - RNA, 1413 nt, Artificial Sequence
  derived and/or modified sequence opt5 from neuraminidase__InfluenzaA__AFP33330
augaaccccaaucagaagaucauuaccaucggcagcauuuccguggccaucgggauuaucucucugauccuccaaauuggaaacaucauuagcaucugggcuucccacucuauucaggccggcagccagaauuacacagggaucugcaaccagaaaauuaucacguaugagaauagaaccugggucaaccaaacauacguuaauaucaacaauaccaacgugguggcgggaaaggacaaaacauccaugacccuggcuggcaauucuagccuuuguccuauucgggggugggccaucuauacaaaggauaacuccauucgcaucggaagcaaaggcgacgucuucgugauuagagaaccguuuaucucuugcucccaucuggagugucggaccuucuuucucacgcagggcgcccugcuuaaugauaagcacagcaacgggaccaucaaggaccgcucucccuucagagcucugauguccugcccucucggagaagcccccagcccuuacaauucucgguuugaguccguugcuuggagcgccuccgcgugucaugauggccugggguggcugacaauuggaaucucuggccccgacaacggggccguggcuguccucaaauauaacggaauuaucaccgaaacaauuaagagcuggaaaaagcagauccugcgcacccaggaguccgagugcguguguguuaauggcagcugcuucacgaucaugacagauggcccuucuaacagagccgcuuccuaccggauuuuuaaaaucgaaaaggggcgcgugaccaagagcauugagcuugacgccccgaauuaucacuacgaagaguguucuugcuaccccgauacaggaaccgucaugugugugugcagagacaacuggcauggcagcaaucggccuuggguguccuucaaccaaaaucuggauuaucagaucggguacauuugcucuggagucuuuggcgacaacccccgcccuaaagauggggagggaagcuguaaucccguuaccguggacggcgcggacggcgugaagggguucuccuauagauacggaaacggcgucuggaucgggcggacaaaaagcaaucgccucagaaagggauuugaaaugauuugggauccgaacggcuggacggacaccgauucugacuucuccaugaaacaggaugugguugccaugacagacuggagcggguauucuggcuccuuugugcagcacccugagcugaccggacuugauugcaugcggcccuguuucugggucgaacuggugagaggccucccucgcgagaauacaaccaucuggacgagcggguccucuaucagcuucugcggaguuaacuccgaaacagcuaauuggucuuggcccgacggcgccgagcugcccuuuaccauugauaaguga

SEQ ID NO: 206178 - RNA, 1413 nt, Artificial Sequence
  derived and/or modified sequence opt5 from neuraminidase__InfluenzaA__AFP33331
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugugaauaucaacaauacaaacguuauugccggaaaagacaagaccucugugacacuggcgggcaauagcucccuuuguagcaucucugggugggcuauuuacaccaaagauaacuccauccggauuggaagcaagggcgacguguucgucauccgcgaaccuuuuaucucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucuguugccuggagcgcuuccgccugucaugauggcaugggguggcugaccauuggaaucagcggcccugacaacggggcgguggccguccugaaauauaacggaauuaucacagaaaccauuaagucuuggaaaaagagaauccuccggacgcaggaguccgagugcguguguguuaauggcagcugcuuuacaaucaugaccgauggccccucuaacggggcugccagcuacaaaauuuucaagaucgaaaagggaaaagugacaaaguccauugagcugaaugcuccuaacuuucacuaugaagaguguucuugcuacccggacaccggcaccgucaugugugugugccgcgauaauuggcacgggagcaacagacccuggguguccuucaaucagaaccuugacuaccagaucggauauauuugcagcggcgucuuuggggauaauccucggcccaaagacggagagggcucuuguaacccuguuacaguggauggcgccgacggggugaagggauucuccuacaaauauggcaauggggucuggaucggacgcacgaaguccaacagacugcggaaaggcuuugaaaugauuugggaccccaauggguggaccgauacagacucugauuucuccgugaagcaagacguuguggcgaucaccgauuggagcggcuacuccggaucuuuuguccagcauccggagcucacaggccuggacugcauccgcccuuguuucuggguggaacuuguuagagggcugccccgggagaacaccacgauuuggacaagcggauccucuaucagcuucugcggcgucaauuccgauaccgccaacuggagcuggccugacggggcugaacuccccuuuaccauugauaaguga

SEQ ID NO: 206179 - RNA, 1410 nt, Artificial Sequence; identical to SEQ ID NO: 204167
  derived and/or modified sequence opt5 from neuraminidase__InfluenzaA__AFQ32576

SEQ ID NO: 206180 - RNA, 1410 nt, Artificial Sequence
  derived and/or modified sequence opt5 from neuraminidase__InfluenzaA__AFQ37282
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccgggggauccagcauuucuuuuuguggcguuaauuccgacacagugggguggagcuggcccgauggagcugagcugccuuucaccaucgacaaguga

SEQ ID NO: 206181 - RNA, 1410 nt, Artificial Sequence
  derived and/or modified sequence opt5 from neuraminidase__InfluenzaA__AFQ55691
augaaccccaaucagaagaucauuaccaucggcguggucaacacaacgcugagcaccauugcccuccugaucgggguuggaaaucuuguguucaacacagugauucacgagaaaaucggcgaccaucaaaccgucacacacccuaccacaaccacgccggcuauccccaauugcuccgauaccauuaucacauacaacaauaccauuaucaacaauauuacaaccacgaucauuacagaagccgagagaccuuuuaagucuccccugccucucugucccuuccggggguuuuucccuuuucauaaagacaacgcgauccgccugggagaaaauaaggaugugaucguuaccagagagccguaugugagcugcgacaacgauaauuguugguccuucgcucuugcccagggcgcccugcucgggacaaaacacucuaacggaaccauuaaggaccggacccccuaccgcagccugaucagauuuccuauuggcacagcucccguccugggcaauuauaaggaaaucugcauugccugguccucuagcuccuguuucgaugggaaagaguggaugcaugugugcaugacgggaaacgacaacgaugcuagcgcccagaucaucuacgcgggcaagaugaccgacucuauuaaauccuggcggaaggauauccuccgcacacaggagagcgaaugucaaugcauugacgggaccuguguuguggccgucacagauggaccugcugccucuuccgcugaccacagaaucuauuggauucgggagggcaaaaucaucaaguacgaagacgugcccaagaccaaaauucagcaccuggaggagugcagcuguuauguggaugucgacguuuacugcaucugccgcgauaauuggaaggggucuaacagaccguggaugcggauuaauaacgaaacgauccuugagacaggauacguguguuccaaauuucauagcgacaccccucgccccgccgauccuuccaccgugucuugcgacagccccuccaaugucaacggcggccccggggugaagggauucggcuuuaaagcggggaaugauguuuggcugggaagaacagugagcaccucuggccgguccggguucgaaauuaucaaggucacagagggauggauuaacagcccuaaucacgccaaaucuaucacgcagacccucaugagcaacaaugacugguccggcuauucuggcagcuuuaucauuaagacaaaggauuguuuccagccgugcuucuacguggaacugauccgcgggagacccaacaaaaaugacgauguuuccuggaccagcaacucuauugugacauuuuguggacuugacaaugagccuggcuccgggaacuggcccgacggaagcaacaucggcuucaugccuaaguga

SEQ ID NO: 206182 - RNA, 1410 nt, Artificial Sequence
  derived and/or modified sequence opt5 from neuraminidase__InfluenzaA__AFR68156
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuaucauuacgaagagugcucuuguuacccugauagcuccgagaucacaugcguuugccgggacaacuggcacggcagcaaucgccccugggugucuuucaaccagaaucuggaauaucagauuggguacaucuguuccggaauuuuuggcgauaacccuagacccaaugacaaaaccgggagcugcggaccggugucuuccaacggcgccaauggggucaagggauucagcuuuaaguauggcaacggcguguggaucgggcggacaaaauccauuucuagccgcaagggauucgagaugaucugggauccuaacggcuggaccgggaccgacaauaacuuuuccaucaaacaagacauuguuggaaucaaugaauggucuggcuacagcggguccuucgugcagcaucccgagcuuacaggccuggauuguauuagaccuugcuucugggucgaacucauccggggacgccccaaggagaacacgauuuggaccagcggcuccuccaucagcuuuugugggguuaauucugacacagugggaugguccuggcccgauggcgcugagcugccuuucaccaucgacaaauga

SEQ ID NO: 206183 - RNA, 1410 nt, Artificial Sequence; identical to SEQ ID NO: 206182
  derived and/or modified sequence opt5 from neuraminidase__InfluenzaA__AFR68166

SEQ ID NO: 206184 - RNA, 1410 nt, Artificial Sequence
  derived and/or modified sequence opt5 from neuraminidase__InfluenzaA__AFR68176
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggcuuccuggagcaaagacauccugcgcacccaggagucugaaugugucugcauuaacgggacaugugccguggugaugacggauggauccgcgagcggcaaggccgacaccaaaauccucuuuaucaaggaggggaagauuguccauacauccacccugucuggaagcgcucaacacguugaggaaugcuccugcuauccuagauaccccggcgugcggugugugugccgcgauaacuggaaagggagcaauagaccuaucgucgacauuaacaucaaggaccacucuauuguguccagcuacguuuguucuggacuugugggcgauacaccccggaaaaaugacagcuccucuagcggccauugccuggauccgaacaaugaggaagggggacacggcgucaaggggugggccuucgacgauggaaacgacguguggaugggccgcaccaucaaugagacguccagacucggguaugaaacauuuaaaguuaucgagggauggagcaacccuaagucuaaacugcagauuaaucgccaggugaucgucgaucggggcaacagauccggcuacagcgggauuuucucuguggagggaaagaauuguaucaaccggugcuuuuaugucgaacugauuagaggccgcaaggaggaaaccgaggugcucuggaccuccaauagcaucguuguguucugugggacauccggaaccuacggcacagggucuuggcccgacggcgcugaucugaaccuuaugccuauuuga

SEQ ID NO: 206185 - RNA, 1410 nt, Artificial Sequence; identical to SEQ ID NO: 199762
  derived and/or modified sequence opt5 from neuraminidase__InfluenzaA__AFR84677

SEQ ID NO: 206186 - RNA, 1410 nt, Artificial Sequence; identical to SEQ ID NO: 200649
  derived and/or modified sequence opt5 from neuraminidase__InfluenzaA__AFR84687

SEQ ID NO: 206187 - RNA, 1410 nt, Artificial Sequence; identical to SEQ ID NO: 199752
  derived and/or modified sequence opt5 from neuraminidase__InfluenzaA__AFR84696

SEQ ID NO: 206188 - RNA, 1410 nt, Artificial Sequence; identical to SEQ ID NO: 199762
  derived and/or modified sequence opt5 from neuraminidase__InfluenzaA__AFR84706

SEQ ID NO: 206189 - RNA, 1410 nt, Artificial Sequence; identical to SEQ ID NO: 199752
  derived and/or modified sequence opt5 from neuraminidase__InfluenzaA__AFR84716

SEQ ID NO: 206190 - RNA, 1410 nt, Artificial Sequence; identical to SEQ ID NO: 199752
  derived and/or modified sequence opt5 from neuraminidase__InfluenzaA__AFR84726

SEQ ID NO: 206191 - RNA, 1410 nt, Artificial Sequence; identical to SEQ ID NO: 199752
  derived and/or modified sequence opt5 from neuraminidase__InfluenzaA__AFR84736

SEQ ID NO: 206192 - RNA, 1410 nt, Artificial Sequence; identical to SEQ ID NO: 199752
  derived and/or modified sequence opt5 from neuraminidase__InfluenzaA__AFR84746

SEQ ID NO: 206193 - RNA, 1410 nt, Artificial Sequence; identical to SEQ ID NO: 199752
  derived and/or modified sequence opt5 from neuraminidase__InfluenzaA__AFR84756

SEQ ID NO: 206194 - RNA, 1410 nt, Artificial Sequence; identical to SEQ ID NO: 199752
  derived and/or modified sequence opt5 from neuraminidase__InfluenzaA__AFR84766

SEQ ID NO: 206195 - RNA, 1410 nt, Artificial Sequence; identical to SEQ ID NO: 199752
  derived and/or modified sequence opt5 from neuraminidase__InfluenzaA__AFR84776

SEQ ID NO: 206196 - RNA, 1410 nt, Artificial Sequence; identical to SEQ ID NO: 199752
  derived and/or modified sequence opt5 from neuraminidase__InfluenzaA__AFR84786

SEQ ID NO: 206197 - RNA, 1410 nt, Artificial Sequence; identical to SEQ ID NO: 199752
  derived and/or modified sequence opt5 from neuraminidase__InfluenzaA__AFR84796

SEQ ID NO: 206198 - RNA, 1410 nt, Artificial Sequence; identical to SEQ ID NO: 199762
  derived and/or modified sequence opt5 from neuraminidase__InfluenzaA__AFR84806

SEQ ID NO: 206199 - RNA, 1410 nt, Artificial Sequence; identical to SEQ ID NO: 199752
  derived and/or modified sequence opt5 from neuraminidase__InfluenzaA__AFR84816

SEQ ID NO: 206200 - RNA, 1410 nt, Artificial Sequence; identical to SEQ ID NO: 199762
  derived and/or modified sequence opt5 from neuraminidase__InfluenzaA__AFR84826

SEQ ID NO: 206201 - RNA, 1410 nt, Artificial Sequence
  derived and/or modified sequence opt5 from neuraminidase__InfluenzaA__AFR84836
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuggcgggugggcuauuuacuccaaggacaacagcgugagaaucggaucuaaaggcgaugucuuugugauccgggagccguucauuuccuguagcccccucgaaugccgcaccuuuuuccugacacagggcgcccuucugaaugacaagcauucuaacgggaccaucaaagauagauccccuuaucggacgcucaugagcugucccauuggagagguuccuucucccuacaacucccgcuuugaaagcguggccugguccgcuucugccugccacgacggcaucaauuggcugaccauugggaucagcggaccugauaacggcgcugucgccgugcugaaguauaaugggaucauuacagacaccaucaaguccuggagaaacaauauucuccggacacaagagagcgagugugcgugcgugaacggaucuuguuucaccgucaugacggauggcccguccaauggccaggccagcuacaaaaucuuucgcauugaaaaggggaaaaucguuaagucuguggagaugaacgcucccaauuaucauuacgaagagugcagcuguuacccugacuccucugagaucacaugcgugugcagagauaacuggcacggaagcaaucggcccugggucuccuucaaccagaaucuggaauaucagauuggcuacaucuguagcgggauuuuuggagacaacccucgccccaaugauaaaaccggcucuugcgggccgguguccagcaacggagccaacggcguuaagggcuucucuuuuaaguaugggaauggaguguggaucggcagaacaaaauccauuagcucccggaacggguucgagaugaucugggacccuaauggauggaccgaaaccgauaacaauuuuucuauuaagcaagacaucgucggcaucaacgaguggagcggguacuccggcucuuucgugcagcaucccgaacuuacaggacuggacuguauucgcccuugcuucuggguugagcucaucagaggccggcccaaagagaauacgauuuggaccagcggguccagcaucucuuuuuguggagugaacuccgauacagucggcuggagcuggcccgacggggcugaacugccuuucaccauugauaaguga

SEQ ID NO: 206202 - RNA, 1410 nt, Artificial Sequence; identical to SEQ ID NO: 200566
  derived and/or modified sequence opt5 from neuraminidase__InfluenzaA__AFR84846

SEQ ID NO: 206203 - RNA, 1410 nt, Artificial Sequence; identical to SEQ ID NO: 199762
  derived and/or modified sequence opt5 from neuraminidase__InfluenzaA__AFR84856

SEQ ID NO: 206204 - RNA, 1410 nt, Artificial Sequence
  derived and/or modified sequence opt5 from neuraminidase__InfluenzaA__AFR84866
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuuucggacgcucaugucuugucccaucggggaggugccuucccccuauaacagccgcuucgaauccguugccuggucugcuagcgccugccacgacggaauuaauuggcugaccaucggcaucuccgggccugauaacggagcuguggccguccugaaguacaauggcauuaucacagacaccauuaagagcuggagaaacaauauccuccggacacaagagucugagugugcgugcgugaacggguccuguuuuaccgugaugacggauggaccgagcgacggccaggccucuuauaaaauuuuccgcaucgaaaagggcaaaaucgucaagagcguugagaugaaugcucccaacuaccauuaugaagagugcuccuguuacccugauucuagcgagauuacaugcgugugcagagacaauuggcacggguccaaccggcccugggugagcuuuaaucagaaccuggaauaccagaucggauauauuuguucuggcaucuucggggauaauccucgccccaacgacaaaaccggauccugcggcccggucagcucuaauggggccaacggagugaagggcuuuuccuucaaguacggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguauucuggcagcuucguccagcaucccgagcuuacaggacuggauuguauccgcccuugcuuuuggguggaacucauuagaggccggcccaaagagaacacgaucuggaccuccgggagcucuauuuccuucuguggaguuaauagcgacacagugggcuggucuuggcccgauggggcugagcugccuuuuaccaucgacaaguga

SEQ ID NO: 206205 - RNA, 1410 nt, Artificial Sequence; identical to SEQ ID NO: 200470
  derived and/or modified sequence opt5 from neuraminidase__InfluenzaA__AFR84876

SEQ ID NO: 206206 - RNA, 1410 nt, Artificial Sequence; identical to SEQ ID NO: 200566
  derived and/or modified sequence opt5 from neuraminidase__InfluenzaA__AFR84895

SEQ ID NO: 206207 - RNA, 1410 nt, Artificial Sequence; identical to SEQ ID NO: 200566
  derived and/or modified sequence opt5 from neuraminidase__InfluenzaA__AFR84905

SEQ ID NO: 206208 - RNA, 1410 nt, Artificial Sequence; identical to SEQ ID NO: 200566
  derived and/or modified sequence opt5 from neuraminidase__InfluenzaA__AFR84915

SEQ ID NO: 206209 - RNA, 1410 nt, Artificial Sequence; identical to SEQ ID NO: 200566
  derived and/or modified sequence opt5 from neuraminidase__InfluenzaA__AFR84925

SEQ ID NO: 206210 - RNA, 1353 nt, Artificial Sequence
  derived and/or modified sequence opt5 from neuraminidase__InfluenzaA__AFU83119
augaaccccaaucagaagaucauuaccaucggcagcgugucccugacaauugccacggucugcuuccucaugcaaaucgcuauucuggccaccacaguuacccuucacuuuaaacagaacgaguguucuaucccuagcuccaaucagguggugccgugcgaacccaucauugucgagagaaacgugacagaauaccgggacuggucuaagccucagugucaaaucaccggguucgcgcccuuuagcaaagauaauuccauucgccugucugcuggaggcgacaucuggguuacaagagagccuuaugugagcugcucccccgauaaguguuaccaguucgcccucgggcagggaaccacgcuggacaacaaacauagcaauggcaccauucacgaucggaucccucaucgcacacuucugaugaacgaacucggggucccguuucaccugggaaccaaacaggugugcauugccuggucuuccagcucuugucaugacggcagagcuuggcugcacguuugcgugacaggcgaugaccggaaugccaccgcuuccuucaucuaugaugggguccucguggacagcaucggaucuuggucccaaaacauucugcgcacgcaggagagcgagugugugugcaucaauggcacauguaccgucguuaugacagauggguccgccucuggcagagcggacacccggauucuuuuuaucaaggaaggaaagauugugcacgugagcccccuguccgggagcgcccagcauaucgaggaaugcucuugcuacccucgcuaucccgaugucagaugugugugccgggacaacuggaagggauccaaucgcccuaucauugacaucagcauggcugauuacggcauugacucuagcuauguuuguuccggccucgugggggauacccccagaaacgacgauucuagcuccaauagcaacugcaaagacccgaacaaugagcggggaaacccuggcgucaaggggugggccuucgauuacggaaaugacguguggaugggccgcacaaucucuaaagauuccagaagcggguacgagacguuucggguuauuggaggcuggaccaucgcuaacucuaagucccaggugaauagacaagucaucguggacaacaauaacuggagcggcuauuccgggauuuucucugucgaaggaaagagcuguaucaaucgcugcuuuuacguggagcugauucggggcagaccccaggaaacacgcguuugguggaccuccaacucuaucguggccuucugugggacaagcggaaccuauggcacgggguccuggccugauggcgcgaauauuaacuuuaugcccaucuga

SEQ ID NO: 206211 - RNA, 1410 nt, Artificial Sequence
  derived and/or modified sequence opt5 from neuraminidase__InfluenzaA__AFV53208
augaaccccaaucagaagaucauuaccaucggcagcgugucccugacaauugccacggucugcuuccucauccaaauugcuauccugguuaccacagugacccuucacuuuaaacagcaugagugugacucuccugccagcaaccaggugaugccgugcgaacccaucauuaucgagagaaauauuacagaaaucgucuaccugaacaauaccacaauugagaaggaaaucuguccuaaagugguugaguaucggaacugguccaagccccagugccaaauuaccggguucgcgccuuuuucuaaagauaauagcauccgccucuccgcuggaggcgacaucugggugacgagagagcccuacgucucuugugauccugggaagugcuaucaguucgcccugggacagggcaccacacuugacaacaagcacagcaaugauaccauucaugaccggaucccgcaccgcacacugcucaugaacgaacugggggugcccuuucaucugggaaccagacagguuuguauugccugguccucuagcuccugccacgauggcaaggcuuggcuccacguguguaucacgggcgacgauaaaaaugccacagcuagcuucauuuacgacgggcggcugauggauucuaucggauccuggagccaaaacauccuucgcacccaggagucugaaugcgucuguauuaauggcacaugcaccguggugaugaccgacggguccgccagcggcagagcggauacacggauccuguuuauugaggagggaaaaaucguccauauuuccccucucucugggagcgcccagcacguugaagagugcuccuguuauccccgcuacccuggagugagaugcaucugucgggacaacuggaagggcagcaaucgccccgugaucgacauuaacauggaagauuauucuaucgacuccagcuacgucugcucuggccuggugggggauacgccgagaaacgacgaucggagcuccaauucuaacugucgcaauccuaacaaugagagaggaaaccagggcguuaaagggugggcuuucgacaauggagaugacguguggaugggccggaccauuagcaaggaucuuagauccggguacgaaacauuuaaggucaucggaggcuggagcacccccaacucuaaaucccaaauuaaucgccaggugaucguugacagcgauaaccggucuggcuauuccgggauuuucagcguggagggaaaguccugcaucaauagauguuuuuacgucgagcugauccgcggccggaaacaggaaacaagagugugguggaccucuaacagcauugucguguucugcgggacguccggaacauauggcaccgggucuuggccugacggcgccaauaucaacuuuaugcccauuuga

SEQ ID NO: 206212 - RNA, 1410 nt, Artificial Sequence
  derived and/or modified sequence opt5 from neuraminidase__InfluenzaA__AFV53219
augaaccccaaucagaagaccaucacaauuggcagcgugucccugacgaucgccaccgucugcuuccucaugcaaauugcuauccuggccacaaccguuacacuucacuuuaaacagcaugagugugacucuccugcgagcaaccaggugaugccgugcgaacccauuaucaucgagagaaauauuaccgaaaucguguaccugaacaauacaaccauugagaaggaaaucuguccugaggucguggaguaucggaacugguccaaaccccagugccaaauuacgggguucgcuccuuuuucuaaggauaauagcauccgccucuccgccggaggcgacauuuggguuaccagagaacccuacgugucuugugauccugggaaaugcuaucaguucgcccugggacagggcacaacccuugacaacaagcacagcaaugggacaauccaugaucggaucccgcaccgcacccugcucaugaacgagcugggaguccccuuucaucugggcacgaaacagguguguguugcuugguccucuagcuccugccacgacggcaaggccuggcuccacgugugugucacaggggaugacagaaaugcuaccgccagcuucauuuacgauggacggcugguggacucuaucggcuccuggagccaaaacauucuucgcacacaggaaucugagugcguguguaucaaugggaccugcaccgucguuaugacagauggauccgcgagcggcagagccgacacgcggauucuguuuaucaaggaggggaaaaucgugcauauuuccccucucucuggaagcgcucagcacaucgaagagugcuccuguuauccccgcuacccugaugugagaugcauuugucgggacaacuggaagggcagcaaucgccccgucaucgacauuaacauggaagauuauucuaucgacuccagcuacgugugcucuggccugguuggggauaccccgagaaacgacgauagcuccucuaauagcaacugucgggacccuaauaacgagcgcggaaaucccggcgugaaagggugggccuucgauaacggagacgaugucuggaugggcagaacaaucaauaaggaaucccggagcggguacgagaccuuuaaggugauuggaggcuggucuacaccuaacuccaaaagccagguuaauagacaagugaucgucgacaacaauaacuggucuggcuauuccgggauuuucagcguggagggaaaguccugcaucaaucgcuguuuuuacgucgaacuuauucggggcagaccccaggagacccgcgugugguggacgucuaacagcaucguuguguucugcgggacauccggaaccuauggcaccgggucuuggcccgauggcgcuaauauuaacuuuaugccuaucuga

SEQ ID NO: 206213 - RNA, 1410 nt, Artificial Sequence
  derived and/or modified sequence opt5 from neuraminidase__InfluenzaA__AFV53230
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugcaaaaucaccggguucgcgccuuuuucuaaggauaauagcauucgccucuccgcuggaggcgacaucugggugacgagagagcccuacgucucuugugauccugggaagugcuaucaauucgcccugggacagggcaccacacuugacaacaaacacagcaaugauaccauccaugaccggauuccgcaccgcacacugcucaugaacgaacugggggugcccuuucaucugggaaccagacagguuuguaucgccugguccucuagcuccugccacgauggcaaggcuuggcuccacgugugugucacgggcgacgauaaaaaugccacagcuagcuucauuuacgacgggcggcugguggauucuaucggauccuggagccagaacauucuucgcacccaagagucugaaugcguguguaucaauggcacaugcaccgucguuaugaccgacggguccgccagcggcagagcggauacaaagauccuguuuauugaggagggaaaaaucgugcauauuuccccucucucugggagcgcccagcacguggaagagugcuccuguuauccccgguacccugacguccgcugcaucuguagagacaacuggaagggaagcaaucggcccgugguugauauuucuauggaagacuauuccaucgauagcucuuacgugugcagcggccuggucggcgacacgccgcgcaacgaugacagauccucuaacagcaauugucggaacccuaauaacgagcgcgggaaucagggagugaagggcugggcuuucgauaacggggacgauguuuggaugggaagaaccaucuccaaagaccuucggagcggcuacgaaacauuuaaggugauugggggauggucuacccccaauuccaaaagccagaucaacagacaagucauuguggauucugacaaucgcuccggcuauagcggcaucuucuccgucgaggggaagucuugcauuaaccgguguuuuuacguggagcugaucagaggacgcaaacaggaaacacggguuugguggaccagcaauuccauuguggucuucugcggcacgucugggacauauggaaccggcagcuggccugacggggccaacaucaaucucaugcccaucuga

SEQ ID NO: 206214 - RNA, 1410 nt, Artificial Sequence; identical to SEQ ID NO: 199429
  derived and/or modified sequence opt5 from neuraminidase__InfluenzaA__AFV53241

SEQ ID NO: 206215 - RNA, 1410 nt, Artificial Sequence; identical to SEQ ID NO: 197115
  derived and/or modified sequence opt5 from neuraminidase__InfluenzaA__AFV53252

SEQ ID NO: 206216 - RNA, 1413 nt, Artificial Sequence
  derived and/or modified sequence opt5 from neuraminidase__InfluenzaA__AFV53263
augaaccccaaucagaagaucauuaccaucggcagcauuugcauggccaucgggacaauuucccugauccuccaaaucggaaacauuaucucuauuuggaucagccacuccauucagacgggcucucagaaucauaccgggaucuguaaccagagaauuaucacauacgagaauaacaccugggugaaucaaacauaugucaacaucagcaauaccaacguuguggcuggaaaagacacaaccuccaugauucuggccggcaauucuagccuuugcccuauccgggggugggcgauuuacuccaaggauaacagcauccgcauuggaucuaaaggcgacguguucgucaucagagaaccguuuaucuccuguagccaccuggagugccggacguucuuucucacccagggcgcucugcuuaaugauaagcauucuaacgggacagugaaagaccgcucccccuauagagcccugaugagcuguccuauuggagaagcccccucuccuuacaauucccgguucgagagcguugcuugguccgccucugcuugccacgauggcaugggguggcucaccaucggaauuagcggccccgacgauggggccguggcgguccugaaguauaacggaaucauuacagaaaucaucaaguccuggcgcaaacagauucugagaacccaggagagcgagugugugugcguuaacggcucuuguuuuacgaucaugacagacggcccuuccaaucggccggccagcuaccgcauuuucaagaucgaaaaagggaagauuaccaaaucuaucgagcucgaugcucccaacagccauuaugaagagugcuccuguuacccugacacaggaaaggugaugugcgucugcagagauaauuggcacggcucuaaccggcccugggugagcuuuaaucaaaaccuggacuaccagauuggguauaucuguuccggaguguucggcgauaauccucgccccaaggacgggaaaggaagcugcgacccggucaacguugauggcgccgacggcgugaagggguuuucuuacagauauggaaauggcguguggaucgggcggaccaaauccaacagcucucgcaagggauucgagaugauuugggauccuaauggcuggaccaacacagacgggaauuuuuccgucaaacaggaugugguugcuaugacggacuggagcggcuacuccggaucuuucgugcagcaccccgaacuuaccggccuggauuguaucagaccuugcuuuugggucgagcucauucgggggagaccccgcgaagagacaaccaucuggacaagcggauccucuauuagcuucuguggcgugaacuccgacaccguuaauuggagcuggcccgauggggccgaacugccuuucacgaucgacaaguga

SEQ ID NO: 206217 - RNA, 1410 nt, Artificial Sequence
  derived and/or modified sequence opt5 from neuraminidase__InfluenzaA__AFV53274
augaaccccaaucagaagaucauuaccaucggcagcgugucccugauuaucgccacagucugcuuccucaugcaaauugcuauccugguuacgaccgugacacuucacuuuaaacagcaugagugugacucuccugccagcaaccaggugaugccgugcgaacccaucauuaucgagagaaauauuaccgaaaucgucuaccugaacaauacaaccauugagaaggaaaucuguccuaaagugguugaguaucggaacugguccaagccccagugccaaauuacaggguucgcgccuuuuucuaaagauaauagcauccgccucuccgcuggaggcgacaucugggugaccagagagcccuacgucucuugugauccugggaagugcuaucaguucgcccugggacagggcacgacccuugacaacaagcacagcaaugauacaauucaugaccggaucccgcaccgcacccugcucaugaacgaacugggggugcccuuucaucugggaacaagacagguuuguguggccugguccucuagcuccugccacgauggcaaggcuuggcuccacgucugugugaccggcgacgauaaaaaugccacggcuagcuucauuuacgacgggcggcugguggauucuaucggauccuggagccaaaacauucuucgcacacaggagucugaaugcgucuguaucaauggaaccugcacaguugugaugaccgacggguccgccagcggcagagcggauacccggauccuguuuauugaggagggcaaaaucgugcauauuuccccucucucugggagcgcccagcacgucgaagagugcuccuguuauccccgcuacccugacgugagaugcaucugucgggacaacuggaagggaagcaaucgccccguuauugauaucaacauggaagacuauucuaucgauuccagcuacgugugcucuggccuggucggcgacacaccgagaaacgaugaccggagcuccaauucuaacugucgcaauccuaacaaugagagagggaaccccggagugaaaggcugggcuuucgauaauggggacgauguuuggaugggacggacgauuagcaaggaccuuagauccggcuacgaaaccuuuaaggugaucgggggauggagcacaccuaacucuaaaucccagauuaaucgccaagucaucguggauagcaacaauuggucuggcuauuccggcauuuucagcgucgaggggaaguccugcaucaaccgguguuuuuacguggagcugauuagaggacgccagcaggaaacccggguuugguggacaucuaauagcaucguggucuucugcggcaccuccgggacguauggaacaggcucuuggcccgacggggccaacaucaauuuuaugcccauuuga

SEQ ID NO: 206218 - RNA, 1410 nt, Artificial Sequence
  derived and/or modified sequence opt5 from neuraminidase__InfluenzaA__AFV53285
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgccauccugaugugagaugcaucugucgggacaacuggaagggcagcaaucgccccgucauuaacaucaacauggaagacuacucuaucgauuccagcuaugugugcucuggccugguuggggacacgccgagaaaugaugacagcuccucuaacagcaauugucgggauccuaacaaugagcgcggaaaccccggcgugaaagggugggccuucgacaauggagaugacgucuggaugggcagaaccauuaacaaggauucccggagcggguacgaaacauuuaaggugaucggaggcuggucuaccccuaauuccaaaagccagguuaacagacaagugauugucgacaauaacaauuggucuggcuacuccgggaucuucagcguggagggaaaguccugcauuaaccgcuguuuuuaugucgagcuuauccggggcagaccccaggaaacacgcgugugguggaccucuaauagcauuguuguguucugcgggacguccggaacauacggcaccgggucuuggcccgauggcgcuaacaucaacuuuaugccuaucuga

SEQ ID NO: 206219 - RNA, 1410 nt, Artificial Sequence
  derived and/or modified sequence opt5 from neuraminidase__InfluenzaA__AFV53296
augaaccccaaucagaagaucauuaucauuggcagcgugucccugaccaucgccacagucugcuuccucaugcaaauugcuauccugguuacgaccgugacacuucacuuuaaacagcaugagugugacucuccugccagcaaccaggugaugccgugcgaacccaucauuaucgagagaaauauuaccgaaaucgucuaccugaacaauacaaccauugagaaggaaaucuguccugaggugguugaguaucggaacugguccaaaccccagugccaaauuacaggguucgcgccuuuuucuaaggauaauagcauccgccucuccgcuggaggcgacaucugggugaccagagaacccuacgucucuugugauccuagcaaaugcuaucaguucgcccuggggcagggaacgacccuugacaacaagcacuccaaugauacaauucaugaccggaucccgcaccgcacccugcucaugaacgagcugggcgugcccuuucaucuggggacaagacagguuuguguggccuggucuagcuccagcugccacgauggaaaggcuuggcuccacgucugugugaccggcgacgauaaaaaugccacggcuucuuucauuuacgacggccggcugguggauuccaucgggagcuggucucaaaacauucuucgcacacaggaauccgagugcgucuguaucaauggaaccugcacaguugugaugaccgacggcagcgccuccgggagagcggauacccggauccuguuuauugaggaaggaaagaucgugcauauuucuccucucagcggcuccgcccagcacgucgaggaaugcagcuguuauccccgcuacccugacgugagaugcaucugucgggacaacuggaaagggucuaaucgccccguuauugauaucaacauggaggacuauuccaucgauagcucuuacgugugcagcggacuggucggcgacacaccgagaaacgaugaccgguccucuaauagcaacugucgcgauccuaauaacgaaagaggcaaucccggggugaagggaugggcuuucgacaacggcgaugacguuuggauggggcggacgauuuccaaagaucuuagaagcggauacgagaccuuuaaggugaucggcggguggucuacaccuaauuccaagagccagauuaaccgccaagucaucguggacucuaauaacugguccggauauagcggcauuuucuccgucgagggcaaaucuugcaucaaucgguguuuuuacguggaacugauuagagggcgccagcaggagacccggguuugguggacaagcaacuccaucguggucuucugcggaaccucuggcacguaugggacaggaagcuggcccgacggcgccaauaucaacuuuaugcccauuuga

SEQ ID NO: 206220 - RNA, 1410 nt, Artificial Sequence
  derived and/or modified sequence opt5 from neuraminidase__InfluenzaA__AFV53307
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacguggaagagugcuccuguuauccccgcuacccugaugucagaugcauuugucgggacaacuggaagggcagcaaucgccccgugaucgacauuaacauggaagauuauucuaucgacuccagcuacguuugcucuggccuggugggggauacgccgagaaacgacgauagcuccucuaauagcaacugucgggacccuaauaacgagcgcggaaaucccggcgucaaagggugggccuucgauaacggagacgauguguggaugggcagaaccaucaauaaggacucccggagcggguacgaaacauuuaagguuauuggaggcuggucuaccccuaacuccaaaagccaggugaauagacaagucaucguggauaacaauaacuggucuggcuauuccgggauuuucagcgucgagggaaaguccugcaucaaucgcuguuuuuacguggagcuuauucggggcagaccccaggaaacacgcguuugguggaccucuaacagcaucguggucuucugcgggacguccggaacauauggcaccgggucuuggcccgacggcgcuaauauuaacuuuaugccuaucuga

SEQ ID NO: 206221 - RNA, 1410 nt, Artificial Sequence
  derived and/or modified sequence opt5 from neuraminidase__InfluenzaA__AFV53317
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucgguccccgcaccgcacacugcucaugaacgagcugggaguccccuuucaucugggcaccaaacaggugugugcugccuggucuagcuccagcugccacgacggcaaggcuuggcuccacguuugugugacgggggaugacagaaaugccacagcgucuuucauuuacgauggacggcuggucgacuccaucggcagcuggucucaaaacauucuucgcacccaggaauccgagugcguguguaucaaugggacaugcaccguggucaugaccgauggaagcgccuccggcagagcugacacacggauucuguuuaucaaggaggggaaaaucguucauauuggaccucucucuggcagcgcccagcacaucgaagagugcuccuguuauccccgcuacccugaugugagaugcauuugucgggacaacuggaagggcagcaaucgccccgugaucgacauuaacauggaagauuauucuaucgacuccagcuacgucugcucugggcuggugggagauacgccgagaaacgacgauagcuccucuaauagcaacugucgggacccuaauaacgagcgcggcaaucccgggguuaaaggaugggcuuucgauaacggcgacgauguguggauggggagaaccaucuccaaggaccuucggagcggauacgaaacauuuaaggucauuggcggcuggucuaccccuaauuccaaaagccaggugaacagacaaguuaucguggauaauaacaauuggucuggguauuccggaauuuucagcgucgagggcaaguccugcaucaaccgcuguuuuuacguggagcugauucgggggagaccccaggaaacacgcgucugguggaccucuaauagcaucgugguuuucugcggaacguccggcacauaugggaccggcucuuggcccgacggagccaacauuaauuuuaugccuaucuga

SEQ ID NO: 206222 - RNA, 1410 nt, Artificial Sequence
  derived and/or modified sequence opt5 from neuraminidase__InfluenzaA__AFV53328
augaaccccaaucagaagaucauuaccaucggcagcgugucccugacaauugccacggucugcuuccucaugcacaucgcuauucuggccaccacaguuacccuucauuuuaaacaacacgagugugacucuccugcgagcaaccaggcuaugccgugcgaacccaucaucauugagagaaauaucacagaaauuguguaccugaacaauaccacaaucgagaaggaaauuuguccugagguggucgaguaucggaacugguccaaaccccagugccagaucaccggguucgccccuuuuucuaaggauaauagcauucgccucuccgccggaggcgacaucugggugacgagagaacccuacguuucuugugauccugggaaaugcuaucaauucgcucugggacagggcaccacacuugacaacaagcauagcaaugggaccauccacgaucggauuccgcaucgcacacugcucaugaacgagcugggagugcccuuucaccugggcaccaagcaggucuguguggccugguccucuagcuccugccacgacggcaaggcuuggcuccauguuuguaucacgggggaugacagaaaugccacagcgagcuucauuuacgauggacggcugguggacucuaucggcuccuggagccagaacauucuucgcacccaagaaucugagugcgucuguaucaaugggacaugcaccguggugaugaccgauggauccgccagcggcagagcugacacacggauccuguuuauuaaagaggggaaaaucguccacauuuccccucucucuggaagcgcccagcauaucgaagagugcuccuguuauccccgcuacccugauguuagaugcauuugucgggacaacuggaagggcagcaaucgccccgugaucgacaucaacauggaagauuauucuauugacuccagcuacgugugcucuggccuggucggggauacgccgagaaacgacgauagcuccucuaauagcaacugucgggacccuaauaacgagcgcggaaaucccggcgugaaagggugggcuuucgauaacggagacgauguuuggaugggcagaaccaucuccaaggaccuucggagcggguacgaaacauuuaaggugauuggaggcuggucuaccccuaauuccaaaagccaggucaacagacaggugaucguugauaauaacaauuggucuggcuauuccgggauuuucagcguggagggaaaguccugcaucaaccgcuguuuuuacgucgagcugauucggggcagaccccaagaaacacgcgugugguggaccucuaauagcaucgucguguucugcgggacguccggaacauauggcaccgggucuuggcccgacggcgccaacaucaauuuuaugccuauuuga

SEQ ID NO: 206223 - RNA, 1410 nt, Artificial Sequence
  derived and/or modified sequence opt5 from neuraminidase__InfluenzaA__AFV53339
augaaccccaaucagaagaucauuaccaucggcagcgccucccugacaauugcuacggugugcuuccucaugcaaaucgccauucuggucaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccuaaagucguggaguaucggaacugguccaagccccagugcaaaaucaccggguucgcuccuuuuucuaaggauaauagcauucgccucuccgccggaggcgacaucuggguuacgagagagcccuacgugucuugugauccugggaagugcuaucaauucgcccugggacagggcaccacacuugacaacaaacacagcaaugauaccauccaugaccggauuccgcaccgcacacugcucaugaacgaacuggggguccccuuucaucugggaaccagacagguguguaucgcuugguccucuagcuccugccacgauggcaaggccuggcuccacguuugugugacgggcgacgauaaaaaugcuacagccagcuucauuuacgacgggcggcuggucgauucuaucggauccuggagccagaacauucuucgcacccaagagucugaaugcguguguaucaauggcacaugcaccguggucaugaccgacggguccgcgagcggcagagccgauacacggauccuguuuauugaggagggaaagaucguucauauguccccucucucugggagcgcucagcacguggaagagugcuccuguuauccccgcuacccugacgugagaugcauuugucgggacaacuggaaaggaagcaaucgccccgucguggauaucaacauggaagacuauucuauugauuccagcuacguuugcucuggccuggugggcgacacgccgagaaacgaugaccggagcuccaauucuaacugucgcaauccuaacaaugagaaggggaaccagggagucaagggcugggccuucgauaauggggacgauguguggaugggaagaaccaucagcaaagaccuucgguccggcuacgaaacauuuaagguuaucgggggauggagcacccccaacucuaaaucccagauuaauagacaagugaucgucgauagcgacaaccgcucuggcuauuccggcauuuucagcguggaggggaaguccugcaucaaucgguguuuuuacgucgagcugauuagaggacgcaaacaggaaacacgggugugguggaccucuaacagcaucguuguguucugcggcacguccgggacauauggaaccggcucuuggccugacggggcuaauauuaaccucaugcccaucuga

SEQ ID NO: 206224 - RNA, 1410 nt, Artificial Sequence; identical to SEQ ID NO: 199762
  derived and/or modified sequence opt5 from neuraminidase__InfluenzaA__AFX96367

SEQ ID NO: 206225 - RNA, 1410 nt, Artificial Sequence; identical to SEQ ID NO: 199762
  derived and/or modified sequence opt5 from neuraminidase__InfluenzaA__AFX96386

SEQ ID NO: 206226 - RNA, 1410 nt, Artificial Sequence; identical to SEQ ID NO: 200116
  derived and/or modified sequence opt5 from neuraminidase__InfluenzaA__AFX96401

SEQ ID NO: 206227 - RNA, 1410 nt, Artificial Sequence; identical to SEQ ID NO: 200116
  derived and/or modified sequence opt5 from neuraminidase__InfluenzaA__AFX96411

SEQ ID NO: 206228 - RNA, 1410 nt, Artificial Sequence; identical to SEQ ID NO: 200116
  derived and/or modified sequence opt5 from neuraminidase__InfluenzaA__AFX96421

SEQ ID NO: 206229 - RNA, 1410 nt, Artificial Sequence; identical to SEQ ID NO: 200116
  derived and/or modified sequence opt5 from neuraminidase__InfluenzaA__AFX96431

SEQ ID NO: 206230 - RNA, 1410 nt, Artificial Sequence; identical to SEQ ID NO: 200116
  derived and/or modified sequence opt5 from neuraminidase__InfluenzaA__AFX96441

SEQ ID NO: 206231 - RNA, 1410 nt, Artificial Sequence; identical to SEQ ID NO: 200116
  derived and/or modified sequence opt5 from neuraminidase__InfluenzaA__AFX96451

SEQ ID NO: 206232 - RNA, 1410 nt, Artificial Sequence; identical to SEQ ID NO: 200116
  derived and/or modified sequence opt5 from neuraminidase__InfluenzaA__AFX96461

SEQ ID NO: 206233 - RNA, 1410 nt, Artificial Sequence; identical to SEQ ID NO: 199762
  derived and/or modified sequence opt5 from neuraminidase__InfluenzaA__AFX96471

SEQ ID NO: 206234 - RNA, 1410 nt, Artificial Sequence; identical to SEQ ID NO: 199762
  derived and/or modified sequence opt5 from neuraminidase__InfluenzaA__AFX96481

SEQ ID NO: 206235 - RNA, 1410 nt, Artificial Sequence; identical to SEQ ID NO: 199762
  derived and/or modified sequence opt5 from neuraminidase__InfluenzaA__AFX96491

SEQ ID NO: 206236 - RNA, 1410 nt, Artificial Sequence; identical to SEQ ID NO: 199762
  derived and/or modified sequence opt5 from neuraminidase__InfluenzaA__AFX96501

SEQ ID NO: 206237 - RNA, 1410 nt, Artificial Sequence; identical to SEQ ID NO: 199762
  derived and/or modified sequence opt5 from neuraminidase__InfluenzaA__AFX96511

SEQ ID NO: 206238 - RNA, 1410 nt, Artificial Sequence
  derived and/or modified sequence opt5 from neuraminidase__InfluenzaA__AFX96521
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccagacagagcguggucuccgugaaacuugcgggaaauucuagccugugcccuguuuccgggugggcuauuuacagcaaggacaacucuauccggaucggcuccaaaggggauguguuugucauucgcgagccguucaucagcuguucuccccucgaaugcagaaccuuuuuccugacacagggagcccuucugaaugacaagcauuccaacggcaccauuaaagaucggagcccuuaucgcacgcucaugucuugucccaucggcgaggugccuucccccuacaacagcagauuugaauccguugccuggucugcuagcgccugccacgacgggauuaauuggcugaccaucggaaucuccggcccugauaacggggcuguggccguccugaaguauaauggaauuaucacagacaccauuaagagcuggcggaacaauauccuccgcacacaagagucugagugugcgugcgugaacggcuccuguuucaccgugaugacggaugggccgagcgacggacaggccucuuacaaaauuuuuagaaucgaaaagggcaaaaucgucaagagcguugagaugaaugcucccaacuaucauuacgaagagugcuccuguuacccugauucuagcgagauuacaugcgugugccgggacaauuggcacggcuccaaccgccccugggugagcuucaaucagaaccuggaauaucagaucggguacauuuguucuggaaucuuuggcgauaauccuagacccaacgacaaaaccggguccugcggaccggucagcucuaauggcgccaacggggugaagggauucuccuuuaaguauggcaacggcguuuggauugggcggacaaaaagcaucuccucucgcaauggauucgagaugauuugggauccuaacggcuggaccgggaccgacaauaacuuuagcaucaagcaagacaucgugggaauuaaugaaugguccggcuacucugggagcuucguccagcaucccgagcuuacaggccuggauuguaucagaccuugcuucuggguggaacucauucggggacgccccaaagagaacacgaucuggaccuccggcagcucuauuuccuuuugugggguuaauagcgacacagugggauggucuuggcccgauggcgcugagcugccuuucaccaucgacaaguga

SEQ ID NO: 206239 - RNA, 1410 nt, Artificial Sequence; identical to SEQ ID NO: 199762
  derived and/or modified sequence opt5 from neuraminidase__InfluenzaA__AFX96531

SEQ ID NO: 206240 - RNA, 1410 nt, Artificial Sequence; identical to SEQ ID NO: 199762
  derived and/or modified sequence opt5 from neuraminidase__InfluenzaA__AFX96541

SEQ ID NO: 206241 - RNA, 1410 nt, Artificial Sequence; identical to SEQ ID NO: 199762
  derived and/or modified sequence opt5 from neuraminidase__InfluenzaA__AFX96551

SEQ ID NO: 206242 - RNA, 1410 nt, Artificial Sequence; identical to SEQ ID NO: 204286
  derived and/or modified sequence opt5 from neuraminidase__InfluenzaA__AFX96561

SEQ ID NO: 206243 - RNA, 1410 nt, Artificial Sequence; identical to SEQ ID NO: 199762
  derived and/or modified sequence opt5 from neuraminidase__InfluenzaA__AFX96571

SEQ ID NO: 206244 - RNA, 1410 nt, Artificial Sequence; identical to SEQ ID NO: 199762
  derived and/or modified sequence opt5 from neuraminidase__InfluenzaA__AFX96581

SEQ ID NO: 206245 - RNA, 1410 nt, Artificial Sequence; identical to SEQ ID NO: 199762
  derived and/or modified sequence opt5 from neuraminidase__InfluenzaA__AFX96591

SEQ ID NO: 206246 - RNA, 1410 nt, Artificial Sequence; identical to SEQ ID NO: 199762
  derived and/or modified sequence opt5 from neuraminidase__InfluenzaA__AFX96601

SEQ ID NO: 206247 - RNA, 1410 nt, Artificial Sequence; identical to SEQ ID NO: 199762
  derived and/or modified sequence opt5 from neuraminidase__InfluenzaA__AFX96611

SEQ ID NO: 206248 - RNA, 1410 nt, Artificial Sequence; identical to SEQ ID NO: 199762
  derived and/or modified sequence opt5 from neuraminidase__InfluenzaA__AFX96621

SEQ ID NO: 206249 - RNA, 1410 nt, Artificial Sequence; identical to SEQ ID NO: 199762
  derived and/or modified sequence opt5 from neuraminidase__InfluenzaA__AFX96631

SEQ ID NO: 206250 - RNA, 1410 nt, Artificial Sequence
  derived and/or modified sequence opt5 from neuraminidase__InfluenzaA__AFX96641
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagcaaguuugaauccguugccuggucugcuagcgccugccacgacggaauuaauuggcugaccaucggcaucuccgggccugauaacggagcuguggccguccugaaguauaauggcauuaucacagacaccauuaaaagcuggcgcaacaauauccucagaacacaagagucugagugugcgugcgugaacggguccuguuucaccgugaugacggauggaccgagcgacggccaggccucuuacaagauuuuucggaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaucuccucuagaaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguauccggccuugcuucuggguggaacucauucgcggcagacccaaggagaacacgaucuggaccuccgggagcucuauuuccuuuuguggaguuaauagcgacacagugggcuggucuuggcccgauggggcugagcugccuuucaccaucgacaaauga

SEQ ID NO: 206251 - RNA, 1410 nt, Artificial Sequence; identical to SEQ ID NO: 199762
  derived and/or modified sequence opt5 from neuraminidase__InfluenzaA__AFX96651

SEQ ID NO: 206252 - RNA, 1410 nt, Artificial Sequence; identical to SEQ ID NO: 199762
  derived and/or modified sequence opt5 from neuraminidase__InfluenzaA__AFX96661

SEQ ID NO: 206253 - RNA, 1410 nt, Artificial Sequence; identical to SEQ ID NO: 199762
  derived and/or modified sequence opt5 from neuraminidase__InfluenzaA__AFX96671

SEQ ID NO: 206254 - RNA, 1410 nt, Artificial Sequence; identical to SEQ ID NO: 199762
  derived and/or modified sequence opt5 from neuraminidase__InfluenzaA__AFX96681

SEQ ID NO: 206255 - RNA, 1410 nt, Artificial Sequence; identical to SEQ ID NO: 199762
  derived and/or modified sequence opt5 from neuraminidase__InfluenzaA__AFX96691

SEQ ID NO: 206256 - RNA, 1410 nt, Artificial Sequence
  derived and/or modified sequence opt5 from neuraminidase__InfluenzaA__AFX96701
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugugaagucugucgagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcuucaauggggccaacggagucaagggcuuuucuuucaaguauggcaacgggguguggaucggaagaacaaaauccauuagcucccggaauggcuuugagaugaucugggauccuaacggguggaccggaaccgacaauaacuucucuaucaagcaagacauuguuggcaucaaugaauggagcggguacuccggcucuuucgugcagcaucccgagcuuacaggacuggauuguauucgcccuugcuuuugggucgaacucaucagaggccggcccaaagagaacacgauuuggaccagcggguccaucaucagcuucuguggagugaauagcgacacaguuggcugguccuggcccgauggggcugagcugccuuuuaccauugacaaguga

SEQ ID NO: 206257 - RNA, 1410 nt, Artificial Sequence; identical to SEQ ID NO: 199762
  derived and/or modified sequence opt5 from neuraminidase__InfluenzaA__AFX96711

SEQ ID NO: 206258 - RNA, 1410 nt, Artificial Sequence
  derived and/or modified sequence opt5 from neuraminidase__InfluenzaA__AFX96721
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgguuuggaccuccgggagcucuaucuccuuuuguggagugaauagcgacacagucggcuggucuuggcccgauggggcugagcugccuuucaccauugacaaguga

SEQ ID NO: 206259 - RNA, 1410 nt, Artificial Sequence; identical to SEQ ID NO: 206258
  derived and/or modified sequence opt5 from neuraminidase__InfluenzaA__AFX96731

SEQ ID NO: 206260 - RNA, 1410 nt, Artificial Sequence; identical to SEQ ID NO: 199762
  derived and/or modified sequence opt5 from neuraminidase__InfluenzaA__AFX96741

SEQ ID NO: 206261 - RNA, 1410 nt, Artificial Sequence; identical to SEQ ID NO: 199762
  derived and/or modified sequence opt5 from neuraminidase__InfluenzaA__AFX96751

SEQ ID NO: 206262 - RNA, 1410 nt, Artificial Sequence; identical to SEQ ID NO: 200780
  derived and/or modified sequence opt5 from neuraminidase__InfluenzaA__AFX96761

SEQ ID NO: 206263 - RNA, 1410 nt, Artificial Sequence; identical to SEQ ID NO: 199762
  derived and/or modified sequence opt5 from neuraminidase__InfluenzaA__AFX96771

SEQ ID NO: 206264 - RNA, 1410 nt, Artificial Sequence
  derived and/or modified sequence opt5 from neuraminidase__InfluenzaA__AFX96791
augaaccccaaucagaagaucauuaccaucggcagcgugugcaugacaauugggauggccaaccugauccuccaagucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcaucaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 206265 - RNA, 1410 nt, Artificial Sequence; identical to SEQ ID NO: 206264
  derived and/or modified sequence opt5 from neuraminidase__InfluenzaA__AFX96801

SEQ ID NO: 206266 - RNA, 1410 nt, Artificial Sequence
  derived and/or modified sequence opt5 from neuraminidase__InfluenzaA__AFX96811
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugagacuugcgggaaauucuagccugugcccuguuuccggcugggcuauuuacagcaaagacaacucuauccggaucggguccaagggagauguguuugucauucgcgagccguucaucagcuguucuccccucgaaugcagaaccuuuuuccugacacagggcgcccuucugaaugacaaacauuccaacggcaccauuaaggaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 206267 - RNA, 1410 nt, Artificial Sequence; identical to SEQ ID NO: 199762
  derived and/or modified sequence opt5 from neuraminidase__InfluenzaA__AFX96821

SEQ ID NO: 206268 - RNA, 1410 nt, Artificial Sequence; identical to SEQ ID NO: 206264
  derived and/or modified sequence opt5 from neuraminidase__InfluenzaA__AFX96831

SEQ ID NO: 206269 - RNA, 1410 nt, Artificial Sequence
  derived and/or modified sequence opt5 from neuraminidase__InfluenzaA__AFX96841
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugagacuugcgggaaauucuagccugugcccuguuuccggcugggcuauuuacagcaaagacaacucuauccggaucggguccaagggagauguguuugucauucgcgagccguucaucagcuguucuccccucgaaugcagaaccuuuuuccugacacagggcgcccuucugaaugacaaacauuccaacggcaccauuaaggaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuauuacuacgaagagugcuccuguuauccugauucuagcgagauuacaugcgugugccgggacaauuggcauggguccaaccgccccugggugagcuucaaucagaaccuggaauaccagaucggauauauuuguucuggcaucuuuggggauaauccuagacccaacgacaagaccggauccugcggcccggucagcucuaauggggccaacggagugaaaggcuucuccuuuaaguacggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguauucuggcagcuucguccagcaccccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 206270 - RNA, 1410 nt, Artificial Sequence; identical to SEQ ID NO: 199762
  derived and/or modified sequence opt5 from neuraminidase__InfluenzaA__AFX96859

SEQ ID NO: 206271 - RNA, 1410 nt, Artificial Sequence; identical to SEQ ID NO: 199762
  derived and/or modified sequence opt5 from neuraminidase__InfluenzaA__AFX96907

SEQ ID NO: 206272 - RNA, 1410 nt, Artificial Sequence; identical to SEQ ID NO: 199762
  derived and/or modified sequence opt5 from neuraminidase__InfluenzaA__AFX96917

SEQ ID NO: 206273 - RNA, 1410 nt, Artificial Sequence; identical to SEQ ID NO: 199762
  derived and/or modified sequence opt5 from neuraminidase__InfluenzaA__AFX96927

SEQ ID NO: 206274 - RNA, 1410 nt, Artificial Sequence
  derived and/or modified sequence opt5 from neuraminidase__InfluenzaA__AFX96937
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuagcacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 206275 - RNA, 1410 nt, Artificial Sequence; identical to SEQ ID NO: 199752
  derived and/or modified sequence opt5 from neuraminidase__InfluenzaA__AFY23991

SEQ ID NO: 206276 - RNA, 1410 nt, Artificial Sequence; identical to SEQ ID NO: 199762
  derived and/or modified sequence opt5 from neuraminidase__InfluenzaA__AFY24001

SEQ ID NO: 206277 - RNA, 1410 nt, Artificial Sequence; identical to SEQ ID NO: 199762
  derived and/or modified sequence opt5 from neuraminidase__InfluenzaA__AFY24022

SEQ ID NO: 206278 - RNA, 1410 nt, Artificial Sequence; identical to SEQ ID NO: 199762
  derived and/or modified sequence opt5 from neuraminidase__InfluenzaA__AFY24043

SEQ ID NO: 206279 - RNA, 1410 nt, Artificial Sequence
  derived and/or modified sequence opt5 from neuraminidase__InfluenzaA__AFY24153
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaccgacuacucuauuguuuccagcuauguguguucuggacuugucggcgacacgccccggaaaaaugauagcuccucuagcucccauugccuggacccgaacaaugaggaaggcgggcacggagugaagggcugggccuucgaugacgggaacgauguuuggaugggaagaacaaucagcgagaaacuccgcucuggcuacgagaccuuuaaggugaucgaagggugguccaauccuaacagcaaacugcagauuaauagacaggucaucguggaccggggaaaccgcucuggcuauuccggcauuuucagcgucgaggggaaguccuguaucaauagaugcuuuuacguggaacugauucggggaagaaaagaggaaaccgagguucucuggacaucuaacagcaucguggucuucuguggcaccuccgggacauauggaacgggcucuuggcccgauggggcugacauuaaucugaugccuaucuga

SEQ ID NO: 206280 - RNA, 1410 nt, Artificial Sequence
  derived and/or modified sequence opt5 from neuraminidase__InfluenzaA__AFY24208
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacaaucggacgccguaucgcacacuccugaugaacgaacugggcgugcccuuucaucucgggaccaagcaggucugcauugccugguccucuagcuccugucacgauggaaaagccuggcugcaugugugcguuacaggcgacgaugagaaugcuaccgccagcuucaucuacaacggcagacuuguggacucuauugucuccuggagcaagaaaauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaauuggaaggggagcaaccgcccuaucguggacauuaauaucaaagauuacucuauuguuuccagcuauguguguucuggacuugucggcgacacccccagaaagaacgacagcuccucuagcucccauugccuggauccgaauaacgaggaaggcgggcacggagugaaaggcugggccuucgacgaugggaaugacguuuggaugggacggacgaucagcgagcgccucagaucuggcuacgagacauuuaaggugaucgaagggugguccaacccuaauagcaaacugcagauuaaccggcaggucaucguggaucgcggaaauagaucuggcuauuccggcauuuucagcgucgaggggaaguccuguaucaaccggugcuuuuacguggaacugauuagaggacgcaaacaggagaccgaaguucucuggaccucuaauagcaucguggucuucuguggcacauccgggaccuauggaacaggcucuuggcccgacggggcugauauuaaccugaugccuaucuga

SEQ ID NO: 206281 - RNA, 1410 nt, Artificial Sequence; identical to SEQ ID NO: 198953
  derived and/or modified sequence opt5 from neuraminidase__InfluenzaA__AFY24219

SEQ ID NO: 206282 - RNA, 1410 nt, Artificial Sequence
  derived and/or modified sequence opt5 from neuraminidase__InfluenzaA__AGB12978
augaaccccaaucagagaaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugcccggcagagcguggucuccgugaaacuugcgggaaauucuagccugugcccuguuuccgggugggcuauuuacagcaaggacaacucuauccgcaucggcuccaagggggauguguuugucauuagagagccguucaucagcuguucuccccucgaaugccggaccuuuuuccugacacagggagcccuucugaaugacaaacauuccaacggcaccauuaaggaucgcagcccuuauagaacgcucaugucuugucccaucggcgaggugccuucccccuacaacagccgguuugaauccguugccuggucugcuagcgccugccacgacgggauuaauuggcugaccaucggaaucuccggcccugauaacggggcuguggccguccugaaauauaauggaauuaucacagacaccauuaagagcuggcgcaacaauauccucagaacacaagagucugagugugcgugcgugaacggcuccuguuucaccauuaugacggaugggccgagcgacggacaggccucuuacaagaucuuucggaucgaaaaaggcaagauugugaaaagcgucgagaugaaugcucccaacuaucauuacgaagagugcuccuguuacccugauucuagcgagaucacaugcguuugccgcgacaauuggcacggcuccaacagacccugggugagcuucaaucagaaccuggaauaucagauuggguacaucuguucuggaauuuuuggcgauaauccucggcccaacgacaagaccggguccugcggaccggugagcucuaauggcgccaacggggucaaaggauucuccuuuaaguauggcaacggcguguggaucgggcgcacaaagagcauuuccucuagaaaaggauucgagaugaucugggauccuaauggcuggaccgggaccgacaacaauuuuagcaucaagcaagacauuguuggaaucaacgaaugguccggcuacucugggagcuucgugcagcaucccgagcuuacaggccuggauuguauucggccuugcuucugggucgaacucauccgcggaagacccaaagagaauacgauuuggaccuccggcagcucuaucuccuuuuguggggugaacagcgacacaguuggauggucuuggcccgauggcgcugagcugccuuucaccaucgacaaguga

SEQ ID NO: 206283 - RNA, 1410 nt, Artificial Sequence; identical to SEQ ID NO: 203281
  derived and/or modified sequence opt5 from neuraminidase__InfluenzaA__AGB12989

SEQ ID NO: 206284 - RNA, 1410 nt, Artificial Sequence; identical to SEQ ID NO: 203733
  derived and/or modified sequence opt5 from neuraminidase__InfluenzaA__AGB13009

SEQ ID NO: 206285 - RNA, 1410 nt, Artificial Sequence; identical to SEQ ID NO: 203733
  derived and/or modified sequence opt5 from neuraminidase__InfluenzaA__AGB13019

SEQ ID NO: 206286 - RNA, 1410 nt, Artificial Sequence; identical to SEQ ID NO: 203733
  derived and/or modified sequence opt5 from neuraminidase__InfluenzaA__AGB13029

SEQ ID NO: 206287 - RNA, 1410 nt, Artificial Sequence; identical to SEQ ID NO: 203982
  derived and/or modified sequence opt5 from neuraminidase__InfluenzaA__AGB13039

SEQ ID NO: 206288 - RNA, 1410 nt, Artificial Sequence; identical to SEQ ID NO: 203733
  derived and/or modified sequence opt5 from neuraminidase__InfluenzaA__AGB13051

SEQ ID NO: 206289 - RNA, 1410 nt, Artificial Sequence
  derived and/or modified sequence opt5 from neuraminidase__InfluenzaA__AGB13069
augaaccccaaucagaagaucauuaccaucggcagcauuugcaugacaaucgggauggccaaccugauucuccaaaucggaaauaucauuuccaucuggauuucucacagcauccagcugggcaaccagaaucagauugagacguguaaccaauccgugaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccuggauuagcuucaaucagaaccuggaauaucagaucggauacauuuguucuggcaucuuuggggauaauccucgccccaacgacaaaaccggauccugcggcccggugagcucuaauggggccaacggagugaagggcuucuccuuuaaguauggcaacggggucuggauuggaagaacaaaaagcaucuccucucggaauggcuucgagaugaucugggauccuaacggguggaccggaaccgacaauaacuuuagcauuaagcaagacaucgugggcauuaaugaaugguccggguacucuggcagcuucguucagcaucccgagcuuacaggacuggauuguauccgcccuugcuucuggguggaacucauuagaggccggcccaaagagaacacgaucuggaccuccgggagcucuaucuccuuuuguggagucaauagcgacacagugggcuggucuuggcccgauggggcugagcugccuuucaccauugacaaguga

SEQ ID NO: 206290 - RNA, 1410 nt, Artificial Sequence
  derived and/or modified sequence opt5 from neuraminidase__InfluenzaA__AGB13074
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggcguccgucaaacuugcuggaaauucuagccugugcccuguguccggcugggccauuuacagcaaggacaacucuguuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugcuuggucugccagcgcuugccacgacggaaucaauuggcugaccauuggcaucuccgggccugauaacggagccguggcgguccugaaguauaauggcaucauuacagacaccaucaagagcuggagaaacaauauucuccggacacaagagucugagugugccugcgugaacggguccuguuucaccgugaugacggauggaccgagcgacggccaggcuucuuacaaaaucuuucgcauugaaaagggcaaaaucgucaagagcguugagaugaaugcccccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggcuaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggccgagcugccuuucaccauugacaaguga

SEQ ID NO: 206291 - RNA, 1410 nt, Artificial Sequence
  derived and/or modified sequence opt5 from neuraminidase__InfluenzaA__AGB13115
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuuguccuccgggagccguucauuagcuguucuccccuggaaugccgcaccuuuuuccuuacacagggcgcccugcucaaugacaagcauuccaacggcaccaucaaagauagaagcccuuaucggacgcugaugucuugucccauuggggaggugccuucccccuacaacagccgcuuugaauccguugccuggucugcuagcgccugccacgacggaaucaauuggcugaccauuggcaucuccgggccugauaacggagcuguggccguccucaaguauaauggcaucauuacagacaccaucaagagcuggagaaacaauauucugcggacacaagagucugagugugcgugcgugaacggguccuguuucaccaucaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcggggguccaaccgccccugggugagcuucaaucagaaccuugaauaucagaucggauacauuuguucuggcaucuuuggggauaauccuagacccaacgacaaaaccggauccugcggcccggugagcucuaauggggccaacggagucaagggcuucuccuuuaaguauggcaacgggguguggauuggacggacaaaaagcaucuccucucgcaagggcuucgagaugauuugggauccuaauggguggaccggaaccgacaacaauuuuagcaucaaacaagacaucguuggcauuaacgaaugguccggguacucuggcagcuucgugcagcaccccgagcugacaggacucgauuguaucagaccuugcuucugggucgaacugauucggggccgccccaaggagaauacgaucuggaccuccgggagcucuauuuccuuuuguggagugaacagcgacacaguuggcuggucuuggcccgauggggcugagcuuccuuucaccaucgacaaauga

SEQ ID NO: 206292 - RNA, 1410 nt, Artificial Sequence; identical to SEQ ID NO: 203733
  derived and/or modified sequence opt5 from neuraminidase__InfluenzaA__AGB13133

SEQ ID NO: 206293 - RNA, 1410 nt, Artificial Sequence; identical to SEQ ID NO: 203281
  derived and/or modified sequence opt5 from neuraminidase__InfluenzaA__AGB13152

SEQ ID NO: 206294 - RNA, 1410 nt, Artificial Sequence; identical to SEQ ID NO: 203281
  derived and/or modified sequence opt5 from neuraminidase__InfluenzaA__AGB13162

SEQ ID NO: 206295 - RNA, 1410 nt, Artificial Sequence; identical to SEQ ID NO: 204104
  derived and/or modified sequence opt5 from neuraminidase__InfluenzaA__AGB13173

SEQ ID NO: 206296 - RNA, 1410 nt, Artificial Sequence
  derived and/or modified sequence opt5 from neuraminidase__InfluenzaA__AGB13183
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggcaagauaacggagcuguggccguccugaaguauaauggcauuaucacagacaccauuaagagcuggagaaacaauauccuccggacacaggagucugagugugcgugcgugaacggguccuguuucaccauuaugacggauggaccuagcgacggccaggccucuuacaaaaucuuucgcaucgaaaagggcaaaauugucaagagcguggagaugaaugcuccgaacuaucauuacgaagagugcuccuguuaccccgauucuagcgagaucacaugcguuugcagagacaauuggcacggguccaaccggccuugggugagcuucaaucagaaccuggaauaucaaauuggauacaucuguucuggcauuuuuggggauaauccccgcccuaacgacaaaaccggauccugcggccccgugagcucuaauggggccaacggagucaagggcuucuccuuuaaguauggcaacgggguguggaucggaagaacaaaaagcauuuccucucggaagggcuucgagaugaucugggauccgaauggguggaccggaaccgacaacaauuuuagcaucaaacaggacauuguuggcaucaacgaaugguccggguacucuggcagcuucgugcagcauccugagcuuacaggacuggauuguauucgccccugcuucugggucgaacucaucagaggccggccuaaggagaauacgauuuggaccuccgggagcucuaucuccuuuuguggagugaacagcgacacaguuggcuggucuuggcccgauggggcugagcugcccuucaccaucgacaaauga

SEQ ID NO: 206297 - RNA, 1410 nt, Artificial Sequence; identical to SEQ ID NO: 203733
  derived and/or modified sequence opt5 from neuraminidase__InfluenzaA__AGB13193

SEQ ID NO: 206298 - RNA, 1410 nt, Artificial Sequence; identical to SEQ ID NO: 203800
  derived and/or modified sequence opt5 from neuraminidase__InfluenzaA__AGB13203

SEQ ID NO: 206299 - RNA, 1410 nt, Artificial Sequence; identical to SEQ ID NO: 203733
  derived and/or modified sequence opt5 from neuraminidase__InfluenzaA__AGB13213

SEQ ID NO: 206300 - RNA, 1410 nt, Artificial Sequence; identical to SEQ ID NO: 203733
  derived and/or modified sequence opt5 from neuraminidase__InfluenzaA__AGB13223

SEQ ID NO: 206301 - RNA, 1410 nt, Artificial Sequence; identical to SEQ ID NO: 203733
  derived and/or modified sequence opt5 from neuraminidase__InfluenzaA__AGB13233

SEQ ID NO: 206302 - RNA, 1410 nt, Artificial Sequence
  derived and/or modified sequence opt5 from neuraminidase__InfluenzaA__AGB13243
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaagaggcaagauugugaaaagcgucgagaugaaugcucccaacuauuacuacgaagagugcuccuguuauccugauucuagcgagaucacaugcguuugccgggacaauuggcauggguccaaccgccccugggugagcuucaaucagaaccuggaauaccagauuggauauaucuguucuggcguguuuggggauaauccuagacccaacgacaagaccggauccugcggcccggucagcucuaauggggccaacggagugaaaggcuucuccuuuaaguacggcaacgggguuuggauuggacggacaaagagcaucuccucucgcaaaggcuucgagaugauuugggauccuaauggguggaccggaaccgacaacaauuuuagcaucaagcaagacaucgugggcauuaacgaaugguccggguauucuggcagcuucguccagcaccccgagcuuacaggacuggauuguaucagaccuugcuucuggguggaacucauucggggccgccccaaagagaauacgaucuggaccuccgggagcucuauuuccuuuuguggaguuaacagcgacacagugggcuggucuuggcccgauggggcugagcugccuuucaccaucgacaaguga

SEQ ID NO: 206303 - RNA, 1410 nt, Artificial Sequence; identical to SEQ ID NO: 203800
  derived and/or modified sequence opt5 from neuraminidase__InfluenzaA__AGB13253

SEQ ID NO: 206304 - RNA, 1410 nt, Artificial Sequence
  derived and/or modified sequence opt5 from neuraminidase__InfluenzaA__AGB13263
augaaccccaaucagaagaucauuaccaucggcagcgugugcaugacaauugggauggccaaccugauccuccaaauuggaaauaucaucuccauuuggaucucucacagcauucagcugggcaaccagaaucagacggagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaagcucccaauuaucauuacgaagagugcuccuguuacccugauucuagcgagauuaccugcgugugcagagacaacuggcacggguccaaucggcccugggugagcuucaaccagaaucuggaauaucgcaucggauacaucuguucuggcauuuuuggggauaacccuagacccaaugacaagacaggauccugcggcccggucagcucuaacggggccaauggagugaagggcuucuccuuuaaauauggcaacgggguuuggaucggacggaccaagagcauuuccucucgcaacggcuucgagaugaucugggauccuaauggguggaccggaacagacaacaauuuuagcauuaaacaggacaucaucggcauuaacgaaugguccggguacucuggcagcuucgugcaacaucccgagcuuacgggacuggauuguaucagaccuugcuucugggucgaacucauucggggccgccccaaggagaauaccaucuggacauccgggagcucuauuuccuuuuguggagugaacagcgacaccguuggcuggucuuggcccgauggggcugagcugccuuucacaguggacaaauga

SEQ ID NO: 206305 - RNA, 1410 nt, Artificial Sequence; identical to SEQ ID NO: 203733
  derived and/or modified sequence opt5 from neuraminidase__InfluenzaA__AGB13273

SEQ ID NO: 206306 - RNA, 1410 nt, Artificial Sequence
  derived and/or modified sequence opt5 from neuraminidase__InfluenzaA__AGB13283
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggcgcggcuucgagaugaucugggauccuaauggguggaccggaaccgacaacaauuuuagcaucaagcaagacauuguuggcaucaacgaaugguccggguacucuggcagcuucgugcagcaucccgagcuuacaggacuggauuguauuagaccuugcuucugggucgaacucauccggggccgccccaaagagaauacgauuuggaccuccgggagcucuaucuccuuuuguggagugaacagcgacacaguuggcuggucuuggcccgauggggcugagcugccuuucaccaucgacaaguga

SEQ ID NO: 206307 - RNA, 1410 nt, Artificial Sequence; identical to SEQ ID NO: 203733
  derived and/or modified sequence opt5 from neuraminidase__InfluenzaA__AGB13293

SEQ ID NO: 206308 - RNA, 1410 nt, Artificial Sequence; identical to SEQ ID NO: 203733
  derived and/or modified sequence opt5 from neuraminidase__InfluenzaA__AGB13303

SEQ ID NO: 206309 - RNA, 1410 nt, Artificial Sequence
  derived and/or modified sequence opt5 from neuraminidase__InfluenzaA__AGB13313
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgcgaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaagggauccugcggcccggugagcucuaauggggcuaacggagucaagggcuucuccuuuaaauauggcaacgggguguggauuggaagaaccaagagcaucuccucucggaauggcuucgagaugauuugggauccuaacggguggacaggaaccgacaauaacuuuagcaucaaacaagacaucguuggcauuaaugaaugguccggguacucuggcagcuucgugcagcaucccgagcuuaccggacuggauuguauccgcccuugcuucugggucgaacucauuagaggccggcccaaggagaacacaaucuggacguccgggagcucuauuuccuuuuguggagugaauagcgacaccguuggcuggucuuggcccgauggggccgagcugccuuucacaaucgacaaauga

SEQ ID NO: 206310 - RNA, 1410 nt, Artificial Sequence; identical to SEQ ID NO: 203733
  derived and/or modified sequence opt5 from neuraminidase__InfluenzaA__AGB13323

SEQ ID NO: 206311 - RNA, 1410 nt, Artificial Sequence
  derived and/or modified sequence opt5 from neuraminidase__InfluenzaA__AGB13333
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccgcggugucugucaaacuugcuggaaacagcucccugugcccugugagcggcugggccauuuacucuaaggacaauuccaucagaaucgggagcaaaggagauguuuuugugauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggucccuagccccuacaacucccgcuuugaaucuguggcuuggagcgccuccgcuugccacgacggaauuaacuggcugaccaucggcaucagcgggccugauaauggagccguugcggugcugaaguauaacggcauuaucacagacaccauuaagucuuggagaaauaacauccuccggacacaagaguccgagugugccugcgucaaugggagcuguuucaccauuaugacggauggaccgucugacggccaggcuagcuacaaaaucuuucgcaucgaaaagggcaaaauugugaaguccguggagaugaacgcccccaauuaucauuacgaagagugcucuuguuacccugauagcuccgagaucacaugcgucugcagagacaacuggcacgggagcaaucggcccuggguuucuuucaaccagaaucuggaauaucagauuggauacaucuguuccggcauuuuuggggauaacccucgccccaaugacaaaaccggaagcugcggcccggugucuuccaacggggcuaauggagugaagggcuucagcuuuaaguauggcaacggggucuggaucggaagaacaaaauccauuucuagccggaagggcuucgagaugaucugggauccuaacggguggaccggaaccgacaauaacuuuuccaucaaacaagacauugugggcaucaaugaauggucuggguacagcggcuccuucguucagcaucccgagcuuacaggacuggauuguauucgcccuugcuucuggguggaacucaucagaggccggcccaaggagaacacgauuuggaccagcgggucuuccaucagcuuuuguggagucaauucugacacagugggcugguccuggcccgauggggccgagcugccuuucaccaucgacaaauga

SEQ ID NO: 206312 - RNA, 1410 nt, Artificial Sequence; identical to SEQ ID NO: 203733
  derived and/or modified sequence opt5 from neuraminidase__InfluenzaA__AGB13343

SEQ ID NO: 206313 - RNA, 1410 nt, Artificial Sequence; identical to SEQ ID NO: 203982
  derived and/or modified sequence opt5 from neuraminidase__InfluenzaA__AGB13353

SEQ ID NO: 206314 - RNA, 1410 nt, Artificial Sequence
  derived and/or modified sequence opt5 from neuraminidase__InfluenzaA__AGB13363
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggcguccgucaaacuugcuggaaauucuagccugugcuccgugagcggcugggccauuuacucuaaggacaacuccaucagaaucgggagcaaaggagauguuuuugugauucgggagccuuucaucucuuguuccccgcucgaaugccgcaccuuuuuccugacacagggcgcccuucugaaugacaagcauagcaacggcaccauuaaagauagaucucccuaucggacgcucauguccuguccuaucggggagguccccagcccuuacaacucccgcuuugaaucuguggcuuggagcgccuccgcuugccacgacggaauuaauuggcugaccaucggcaucagcgggcccgauaacggagccguugcggugcugaaguauaauggcauuaucacagacaccauuaagucuuggagaaacaauauccuccggacacaagaguccgagugugccugcgucaacgggagcuguuucaccauuaugacggauggaccuucugacggccaggcuagcuacaaaaucuuucgcaucgaaaagggcaaaauugugaaguccguggagaugaaugccccgaacuaucauuacgaagagugcucuuguuaccccgauagcuccgagaucacaugcgucugcagagacaauuggcacgggagcaaccggccuuggguuucuuucaaucagaaccuggaauaucagauuggauacaucuguuccggcauuuuuggggauaauccccgcccuaacgacaaaaccggaagcugcggccccgugucuuccaauggggcuaacggagugaagggcuucagcuuuaaguauggcaacggggucuggaucggaagaacaaaauccauuucuagccggaagggcuucgagaugaucugggauccgaauggguggaccggaaccgacaacaauuuuuccaucaaacaagacauugugggcaucaacgaauggucuggguacagcggcuccuucguucagcauccugagcuuacaggacuggauuguauucgccccugcuucuggguggaacucaucagaggccggccuaaggagaauacgauuuggaccagcgggucuuccaucagcuuuuguggagucaacucugacacagugggcugguccuggcccgauggggccgagcugcccuucaccaucgacaaauga

SEQ ID NO: 206315 - RNA, 1410 nt, Artificial Sequence
  derived and/or modified sequence opt5 from neuraminidase__InfluenzaA__AGB13383
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugugaagucugucgagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcagcgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggagugaauagcgacacaguuggcugguccuggcccgauggggcugagcugccuuucaccaucgacaaauga

SEQ ID NO: 206316 - RNA, 1410 nt, Artificial Sequence; identical to SEQ ID NO: 203281
  derived and/or modified sequence opt5 from neuraminidase__InfluenzaA__AGB13393

SEQ ID NO: 206317 - RNA, 1410 nt, Artificial Sequence; identical to SEQ ID NO: 203981
  derived and/or modified sequence opt5 from neuraminidase__InfluenzaA__AGB13403

SEQ ID NO: 206318 - RNA, 1410 nt, Artificial Sequence; identical to SEQ ID NO: 203281
  derived and/or modified sequence opt5 from neuraminidase__InfluenzaA__AGB13413

SEQ ID NO: 206319 - RNA, 1410 nt, Artificial Sequence; identical to SEQ ID NO: 203281
  derived and/or modified sequence opt5 from neuraminidase__InfluenzaA__AGB13423

SEQ ID NO: 206320 - RNA, 1410 nt, Artificial Sequence; identical to SEQ ID NO: 203981
  derived and/or modified sequence opt5 from neuraminidase__InfluenzaA__AGB13433

SEQ ID NO: 206321 - RNA, 1410 nt, Artificial Sequence; identical to SEQ ID NO: 203981
  derived and/or modified sequence opt5 from neuraminidase__InfluenzaA__AGB13443

SEQ ID NO: 206322 - RNA, 1410 nt, Artificial Sequence
  derived and/or modified sequence opt5 from neuraminidase__InfluenzaA__AGB13453
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccuucucuagccggaagggcuuugagaugauuugggauccuaacggguggaccggaaccgacaauaacuucuccaucaaacaagacaucguuggcauuaaugaauggucuggguacagcggcuccuucgugcagcaucccgagcuuacaggacuggauuguauccgcccuugcuuuugggucgaacucauuagaggccggcccaaggagaacacgaucuggaccagcgggucuuccauuagcuucuguggaguuaauucugacacagugggcugguccuggcccgauggggcugagcugccuuuuaccaucgacaaauga

SEQ ID NO: 206323 - RNA, 1410 nt, Artificial Sequence; identical to SEQ ID NO: 203281
  derived and/or modified sequence opt5 from neuraminidase__InfluenzaA__AGB13463

SEQ ID NO: 206324 - RNA, 1410 nt, Artificial Sequence; identical to SEQ ID NO: 203733
  derived and/or modified sequence opt5 from neuraminidase__InfluenzaA__AGB13473

SEQ ID NO: 206325 - RNA, 1410 nt, Artificial Sequence
  derived and/or modified sequence opt5 from neuraminidase__InfluenzaA__AGB13483
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccagcccaaggagaacacgauuuggaccagcgggucuuccaucagcuuuuguggaguuaauucugacacagugggcugguccuggcccgauggggcugagcugccuuucaccaucgacaaauga

SEQ ID NO: 206326 - RNA, 1410 nt, Artificial Sequence; identical to SEQ ID NO: 204018
  derived and/or modified sequence opt5 from neuraminidase__InfluenzaA__AGB13493

SEQ ID NO: 206327 - RNA, 1410 nt, Artificial Sequence; identical to SEQ ID NO: 203810
  derived and/or modified sequence opt5 from neuraminidase__InfluenzaA__AGB13503

SEQ ID NO: 206328 - RNA, 1410 nt, Artificial Sequence; identical to SEQ ID NO: 201224
  derived and/or modified sequence opt5 from neuraminidase__InfluenzaA__AGB13513

SEQ ID NO: 206329 - RNA, 1410 nt, Artificial Sequence; identical to SEQ ID NO: 204016
  derived and/or modified sequence opt5 from neuraminidase__InfluenzaA__AGB13523

SEQ ID NO: 206330 - RNA, 1410 nt, Artificial Sequence; identical to SEQ ID NO: 204016
  derived and/or modified sequence opt5 from neuraminidase__InfluenzaA__AGB13533

SEQ ID NO: 206331 - RNA, 1410 nt, Artificial Sequence; identical to SEQ ID NO: 203733
  derived and/or modified sequence opt5 from neuraminidase__InfluenzaA__AGB13543

SEQ ID NO: 206332 - RNA, 1410 nt, Artificial Sequence; identical to SEQ ID NO: 203733
  derived and/or modified sequence opt5 from neuraminidase__InfluenzaA__AGB13553

SEQ ID NO: 206333 - RNA, 1410 nt, Artificial Sequence
  derived and/or modified sequence opt5 from neuraminidase__InfluenzaA__AGB13563
augaaccccaaucagaagaucauuaccaucggcagcgugugcaugacaauuggggucgccaaccugauccuccaaauuggaaauaucaucuccauuuggaucucucacagcauucagcugggcaaccagaaucagaucgagacguguaaccaauccguuauuaccuacgaaaauaacacaugggugaaucagaccuaugugaacaucucuaauacaaacuucgcugccgggcagagcgucguguccguuaaucuugcgggaaacucuagccugugcccuguguccggcugggcuauuuacagcaaagacaauucuaucagaaucggguccaagggagaugucuuugugauucgggagccguucaucagcuguucuccccucgaaugccgcaccuuuuuccugacacagggcgcccuucugaacgacaaacauuccaacggcaccauuaaggauagaagcccuuaucggacgcucaugucuugucccaucggggagguuccuucccccuacaauagccgcuuugaauccguggccuggucugcuagcgccugccacgacggaauuaacuggcugaccaucggcaucuccgggccugauaauggagcugucgccgugcugaaauauaacggcauuaucacagacaccauuaagagcuggagaaauaacauccuccggacacaagagucugagugugcgugcgugaauggguccuguuucaccauuaugacggauggaccgagcgacggccaggccucuuacaagaucuuucgcaucgaaaaaggcaagauugucaaaagcguugagaugaacgcucccaauuaucauuacgaagagugcuccuguuacccugauucuagcgagaucacaugcgugugcagagacaacuggcacggguccaaucggcccugggugagcuucaaccagaaucuggaauaucagauuggauacaucuguucuggcauuuuuggggauaacccucgccccaaugacaagaccggauccugcggcccggucagcucuaacggggccaacggagugaaaggcuucuccuuuaaguauggcaaugggguuuggaucggaagaacaaagaacauuagcucccggaaaggcuucgagaugaucugggauccuaauggguggaccggaaccgacaacaauuuuucuaucaagcaagacauugugggcaucaacgaauggagcggguacuccggcucuuucguccagcaucccgagcuuacaggacuggauuguauucgcccuugcuucuggguggaacucaucagaggccggcccaaagagaauacgauuuggaccagcggguccagcaucucuuuuuguggaguuaacuccgacacagugggcuggagcuggcccgauggggcugagcugccuuucaccaucgacaaguga

SEQ ID NO: 206334 - RNA, 1410 nt, Artificial Sequence; identical to SEQ ID NO: 203733
  derived and/or modified sequence opt5 from neuraminidase__InfluenzaA__AGB13573

SEQ ID NO: 206335 - RNA, 1410 nt, Artificial Sequence
  derived and/or modified sequence opt5 from neuraminidase__InfluenzaA__AGB13583
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcgugggauccgucaaacuugcgggcaauucuagccugugcccuguguccgggugggcuauuuacagcaaggacaacucuaucagaaucggauccaaaggcgauguuuuugugauucgggagccguucaucagcuguucuccccucgaaugccgcaccuuuuuccugacacagggcgcccuucugaaugacaagcauuccaacgggaccauuaaagauagaagcccuuaucggacgcucaugucuugucccaucggagaggucccuucccccuacaacagccgcuuugaauccguggccuggucugcuagcgccugccacgacggcauuaauuggcugaccaucgggaucuccggaccugauaacggcgcuguugccgugcugaaguauaaugggauuaucacagacaccauuaagagcuggagaaacaauauccuccggacacaagagucugagugugcgugcgucaacggauccuguuucaccauuaugacggauggcccgagcgacggccaggccucuuacaaaaucuuucgcaucgaaaaggggaaaauugucaagagcguggagaugaaugcucccaacuaucauuacgaagagugcuccuguuacccugauucuagcgagaucacaugcgugugcagagacaauuggcacggauccaaccggcccuggguuagcuucaaucagaaccuggaauaucagauuggcuacaucuguucugggauuuuuggagauaauccucgccccaacgacaaaaccggcuccugcgggccggugagcucuaauggagccaacggcgugaagggcuucuccuuuaaguaugggaacggagucuggaucggcagaacaaaaagcauuuccucucggaagggguucgagaugaucugggauccuaauggauggaccggcaccgacaacaauuuuagcaucaaacaagacauuguggggaucaacgaaugguccggcuacucuggcagcuucguucagcaucccgagcuuacaggacuggauuguauucgcccuugcuucuggguggaacucaucagagggcggcccaaggagaauacgauuuggaccuccggaagcucuaucuccuuuuguggcgucaacagcgacacagugggguggucuuggcccgauggagcugagcugccuuucaccaucgacaaauga

SEQ ID NO: 206336 - RNA, 1410 nt, Artificial Sequence; identical to SEQ ID NO: 203733
  derived and/or modified sequence opt5 from neuraminidase__InfluenzaA__AGB13593

SEQ ID NO: 206337 - RNA, 1410 nt, Artificial Sequence; identical to SEQ ID NO: 203733
  derived and/or modified sequence opt5 from neuraminidase__InfluenzaA__AGB13603

SEQ ID NO: 206338 - RNA, 1410 nt, Artificial Sequence; identical to SEQ ID NO: 203733
  derived and/or modified sequence opt5 from neuraminidase__InfluenzaA__AGB13613

SEQ ID NO: 206339 - RNA, 1410 nt, Artificial Sequence; identical to SEQ ID NO: 203733
  derived and/or modified sequence opt5 from neuraminidase__InfluenzaA__AGB13623

SEQ ID NO: 206340 - RNA, 1410 nt, Artificial Sequence
  derived and/or modified sequence opt5 from neuraminidase__InfluenzaA__AGB13633
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuaucaucuccuuuuguggagugaauagcgacacaguuggcuggucuuggcccgauggggcugagcugccuuucaccauugacaaauga

SEQ ID NO: 206341 - RNA, 1410 nt, Artificial Sequence
  derived and/or modified sequence opt5 from neuraminidase__InfluenzaA__AGB13643
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacgggaucagaaucggaucuaaaggcgauguguuugucauucgggagccguucaucuccuguagcccccucgaaugccgcaccuuuuuccugacacagggcgcccuucugaaugacaagcauucuaacgggaccauuaaagauagauccccuuaucggacgcucaugagcugucccaucggagaggugccuucucccuacaacucccgcuuugaaagcguugccugguccgcuucugccugccacgacggcauuaauuggcugaccaucgggaucagcggaccugauaacggcgcuguggccguccugaaguauaaugggauuaucacagacaccauuaaguccuggagaaacaauauccuccggacacaagagagcgagugugugugcgugaacggaucuuguuucaccgucaugacggauggcccguccgacggccaggcgagcuacaaaauuuuucgcaucgaaaaggggaaaaucguuaagucuguggagaugaaugcccccaacuaucauuacgaagagugcagcuguuacccugauuccucugagauuacaugcgugugcagagacaauuggcacggaagcaaccggcccugggucuccuucaaucagaaccuggaauaucagaucggcuacauuuguagcgggaucuuuggagauaauccucgccccaacgacaaaaccggcucuugcgggccgguguccagcaauggagcuaacggcguuaagggcuucucuuuuaaguaugggaacggaguguggauuggcagaacaaaauccaucagcucccggaauggguucgagaugauuugggauccuaacggauggaccggcaccgacaauaacuuuucugucaagcaagacaucaucgggauuaaugaauggagcggcuacuccggaucuuucgugcagcaucccgagcuuacaggccuggauuguauccgcccuugcuucuggguugaacucauuagagggcggcccaaagagaacacgaucuggaccagcggauccagcauuucuuuuuguggcgucaauuccgacacagugggguggagcuggcccgauggagccgagcugccuuucaccaucgacaaguga

SEQ ID NO: 206342 - RNA, 1410 nt, Artificial Sequence
  derived and/or modified sequence opt5 from neuraminidase__InfluenzaA__AGB13653
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugugugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaacuuuagcgucaagcaagacaucaucggcauuaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggccgagcugccuuucaccaucgacaaguga

SEQ ID NO: 206343 - RNA, 1410 nt, Artificial Sequence; identical to SEQ ID NO: 203281
  derived and/or modified sequence opt5 from neuraminidase__InfluenzaA__AGB13663

SEQ ID NO: 206344 - RNA, 1410 nt, Artificial Sequence; identical to SEQ ID NO: 203281
  derived and/or modified sequence opt5 from neuraminidase__InfluenzaA__AGB13724

SEQ ID NO: 206345 - RNA, 1410 nt, Artificial Sequence; identical to SEQ ID NO: 203733
  derived and/or modified sequence opt5 from neuraminidase__InfluenzaA__AGB13734

SEQ ID NO: 206346 - RNA, 1410 nt, Artificial Sequence; identical to SEQ ID NO: 200238
  derived and/or modified sequence opt5 from neuraminidase__InfluenzaA__AGB51359

SEQ ID NO: 206347 - RNA, 1410 nt, Artificial Sequence
  derived and/or modified sequence opt5 from neuraminidase__InfluenzaA__AGB97270
augaaccccaaucagaagaucauuaccaucggcagcgugugcaugacaauugggauggccaaccugauccuccaaauuggaaauaucaucuccauuuggaucucucacagcauucagcugagaaaccagaaucagaucgagacguguaaccaauccgucauuaccuacgaaaauaacacauggguuaaucagaccuaugugaacaucucuaauacaaacuucgcugccggccagagcguggucuccgugaaacuugcggggaauagcagccugugcccuguuuccggaugggcuauuuacagcaaggacaacucuauccggaucggcuccaaaggggauguguuugucauucgcgagccguucaucagcuguucuccccucgaaugcagaaccuuuuuccugacacagggagcccuucugaaugacaagcauuccaacggcaccauuaaagaucggagcccuuaucgcacgcucaugucuugucccaucggcgaggugccuucccccuacaacagcagauuugaauccguugccuggucugcuagcgccugccacgacgggauuaauuggcugaccaucggaaucuccggcccugauaacggggcuauggccgugcugaaguauaauggaauuaucacagacaccauuaagagcuggcggaacaauauccuccgcacacaagagucugagugugcgugcgucaacggcuccuguuucaccauuaugacggaugggccgagcgacggacaggccucuuacaaaaucuuuagaaucgaaaagggcaaaauugugaagucuguggagaugaaugcucccaacuaucauuacgaagagugcuccuguuacccugauucuagcgagaucacaugcgucugccgggacaauuggcacggcuccaaccgccccuggguuagcuucaaucagaaccuggaauaucagauuggguacaucuguucuggaauuuuuggcgauaauccuagacccaacgacaaaaccggguccugcggaccggugagcucuaauggcgccaacggggugaagggauucuccuuuaaguauggcaacggcgucuggaucgggcggacaaaaagcauuuccucucgcaagggauucgagaugaucugggauccuaauggcuggaccgggaccgacaacaauuuuagcaucaaacaagacauugugggaaucaacgaaugguccggcuacucugggagcuucguucagcaucccgagcuuacaggccuggauuguauuagaccuugcuucuggguggaacucauccggggacgccccaaggagaauacgauuuggaccuccggcagcucuaucuccuuuuguggggucaacagcgacacagugggauggucuuggcccgauggcgcugagcugccuuucaccaucgacaaauga

SEQ ID NO: 206348 - RNA, 1410 nt, Artificial Sequence
  derived and/or modified sequence opt5 from neuraminidase__InfluenzaA__AGB97274
augaaccccaaucagaagaucauuaccaucggcagcgugugcaugacaauugggauggccaaccugauccuccaaauuggaaauaucaucuccauuuggaucucucacagcauucagcugagaaaccagaaucagaucgagacguguaaccaauccgucauuaccuacgaaaauaacacauggguuaaucagaccuaugugaacaucucuaauacaaacuucgcugccggccagagcguggucuccgugaaacuugcggggaauagcagccugugcccuguuuccggaugggcuauuuacagcaaggacaacucuauccggaucggcuccaaaggggauguguuugucauucgcgagccguucaucagcuguucuccccucgaaugcagaaccuuuuuccugacacagggagcccuucugaaugacaagcauuccaacggcaccauuaaagaucggagcccuuaucgcacgcucaugucuugucccaucggcgaggugccuucccccuacaacagcagauuugaauccguugccuggucugcuagcgccugccacgacgggauuaauuggcugaccaucggaaucuccggcccugauaacggggcuguggccguccugaaguauaauggaauuaucacagacaccauuaagagcuggcggaacaauauccuccgcacacaagagucugagugugcgugcgugaacggcuccuguuucaccauuaugacggaugggccgagcgacggacaggccucuuacaaaaucuuuagaaucgaaaagggcaaaauugugaagucugucgagaugaaugcucccaacuaucauuacgaagagugcuccuguuacccugauucuagcgagaucacaugcguuugccgggacaauuggcacggcuccaaccgccccugggugagcuucaaucagaaccuggaauaucagauuggguacaucuguucuggaauuuuuggcgauaauccuagacccaacgacaaaaccggguccugcggaccggugagcucuaauggcgccaacggggucaagggauucuccuuuaaguauggcaacggcguguggaucgggcggacaaaaagcauuuccucucgcaagggauucgagaugaucugggauccuaauggcuggaccgggaccgacaacaauuuuagcaucaaacaagacauuguuggaaucaacgaaugguccggcuacucugggagcuucgugcagcaucccgagcuuacaggccuggauuguauuagaccuugcuucugggucgaacucauccggggacgccccaaggagaauacgauuuggaccuccggcagcucuaucuccuuuuguggggugaacagcgacacaguuggauggucuuggcccgauggcgcugagcugccuuucaccaucgacaaauga

SEQ ID NO: 206349 - RNA, 1410 nt, Artificial Sequence; identical to SEQ ID NO: 205170
  derived and/or modified sequence opt5 from neuraminidase__InfluenzaA__AGB97289

SEQ ID NO: 206350 - RNA, 1410 nt, Artificial Sequence
  derived and/or modified sequence opt5 from neuraminidase__InfluenzaA__AGE15475
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcucccuucugaacgacaagcauucuaauggcaccauuaaagauagauccccuuaucggacgcucaugagcugucccaucggggaggugccuucccccuacaacucucgcuuugaaagcguugccugguccgccagcgcuugccacgacggaauuaacuggcugaccaucggcaucucugggccugauaauggagccguggcuguccugaaguauaacggcauuaucacagacaccauuaaguccuggagaaauaacauccuccggacacaagagagcgagugugccugcgugaaugggucuuguuucaccauuaugacggauggaccgagcgacggccaggcguccuacaaaaucuuucgcaucgaaaagggcaaaauugugaagucugucgagaugaacgcccccaauuaucauuacgaagagugcagcuguuacccugauuccagcgagaucacaugcguuugcagagacaacuggcacgggucuaaucggcccuggguguccuucaaccagaaucuggaauaucagauuggauacaucuguagcggcauuuuuggggauaacccucgccccaaugacaaaaccggaucuugcggcccgguguccagcaacggggcuaauggagucaagggcuucuccuuuaaguauggcaacgggguguggaucggaagaacaaaaucuauuagcucccggaagggcuucgagaugaucugggauccuaacggguggaccggaaccgacaauuacuuuucuaucaaacaagacauuguuggcaucaacgaauggagcggguauuccggcagcuucgugcagcaucccgagcuuacaggacuggauuguauucgcccuugcuucugggucgaacucaucagaggccggcccaaggagaauacgauuuggaccucuggguccagcaucucuuuuuguggagugaacuccgacacaguuggcuggagcuggcccgauggggccgagcugccuuucucuaucgacaaauga

SEQ ID NO: 206351 - RNA, 1410 nt, Artificial Sequence
  derived and/or modified sequence opt5 from neuraminidase__InfluenzaA__AGE15476
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcucccuucugaacgacaagcauucuaauggcaccauuaaagauagauccccuuaucggacgcucaugagcugucccaucggggaggugccuucccccuacaacucucgcuuugaaagcguugccugguccgccagcgcuugccacgacggaauuaacuggcugaccaucggcaucucugggccugauaauggagccguggcuguccugaaguauaacggcauuaucacagacaccauuaaguccuggagaaauaacauccuccggacacaagagagcgagugugccugcgugaaugggucuuguuucaccauuaugacggauggaccgagcgacggccaggcguccuacaaaaucuuucgcaucgaaaagggcaaaauugugaagucugucgagaugaacgcccccaauuaucauuacgaagagugcagcuguuacccugauuccagcgagaucacaugcguuugcagagacaacuggcacgggucuaaucggcccuggguguccuucaaccagaaucuggaauaucagauuggauacaucuguagcggcauuuuuggggauaacccucgccccaaugacaaaaccggaucuugcggcccgguguccagcaacggggcuaauggagucaagggcuucuccuuuaaguauggcaacgggguguggaucggaagaacaaaaucuauuagcucccggaagggcuucgagaugaucugggauccuaacggguggaccggaaccgacaauuacuuuucuaucaaacaagacauuguuggcaucaacgaauggagcggguauuccggcagcuucgugcagcaucccgagcuuacaggacuggauuguauucgcccuugcuucugggucgaacucaucagaggccggcccaaggagaauacgauuuggaccucuggguccagcaucucuuuuuguggagugaacuccgacacaguuggcuggagcuggcccgauggggccgagcugccuuucaccaucgacaaauga

SEQ ID NO: 206352 - RNA, 1410 nt, Artificial Sequence; identical to SEQ ID NO: 206182
  derived and/or modified sequence opt5 from neuraminidase__InfluenzaA__AGE15477

SEQ ID NO: 206353 - RNA, 1410 nt, Artificial Sequence
  derived and/or modified sequence opt5 from neuraminidase__InfluenzaA__AGE15478
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcucccuucugaacgacaagcauucuaauggcaccauuaaagauagauccccuuaucggacgcucaugagcugucccaucggggaggugccuucccccuacaacucucgcuuugaaagcguugccugguccgccagcgcuugccacgacggaauuaacuggcugaccaucggcaucucugggccugauaauggagccguggcuguccugaaguauaacggcauuaucacagacaccauuaaguccuggagaaauaacauccuccggacacaagagagcgagugugccugcgugaaugggucuuguuucaccauuaugacggauggaccgagcgacggccaggcguccuacaaaaucuuucgcaucgaaaagggcaaaauugugaagucugucgagaugaacgcccccaauuaucauuacgaagagugcagcuguuacccugauuccagcgagaucacaugcguuugcagagacaacuggcacgggucuaaucggcccuggguguccuucaaccagaaucuggaauaucagauuggauacaucuguagcggcauuuuuggggauaacccucgccccaaugacaaaaccggaucuugcggcccgguguccagcaacggggcuaauggagucaagggcuucuccuuuaaguauggcaacgggguguggaucggaagaacaaaaucuauuagcucccggaagggcuucgagaugaucugggauccuaacggguggaccggaaccgacaauuacuuuucuaucaaacaagacauuguuggcaucaacgaauggagcggguauuccggcagcuucgugcagcaucccgagcuuacaggacuggauuguauucgcccuugcuucugggucgaacucaucagaggccggcccaaggagaauacgauuuggaccucuggguccagcaucucuuuuuguggagugaaauccgacacaguuggcuggagcuggcccgauggggccgagcugccuuucaccaucgacaaguga

SEQ ID NO: 206354 - RNA, 1410 nt, Artificial Sequence
  derived and/or modified sequence opt5 from neuraminidase__InfluenzaA__AGE15479
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcucccuucugaacgacaagcauucuaauggcaccauuaaagauagauccccuuaucggacgcucaugagcugucccaucggggaggugccuucccccuacaacucucgcuuugaaagcguugccugguccgccagcgcuugccacgacggaauuaacuggcugaccaucggcaucucugggccugauaauggagccguggcuguccugaaguauaacggcauuaucacagacaccauuaaguccuggagaaauaacauccuccggacacaagagagcgagugugccugcgugaaugggucuuguuucaccauuaugacggauggaccgaucgacggccaggcgagcuacaaaaucuuucgcauugaaaagggcaaaaucgugaaguccgucgagaugaacgcccccaauuaucauuacgaagagugcucuuguuacccugauagcuccgagauuacaugcguuugcagagacaacuggcacgggagcaaucggcccugggugucuuucaaccagaaucuggaauaucagaucggauacauuuguuccggcaucuuuggggauaacccucgccccaaugacaaaaccggaagcugcggcccggugucuuccaacggggcuaauggagucaagggcuucagcuuuaaguauggcaacgggguguggauuggaagaacaaaauccaucucuagccggaagggcuucgagaugaucugggauccuaacggguggaccggaaccgacaauuacuuuuccauuaaacaagacaucguuggcauuaacgaauggucuggguauagcggcuccuucgugcagcaucccgagcuuacaggacuggauuguauccgcccuugcuucugggucgaacucauuagaggccggcccaaggagaauacgaucuggaccagcgggucuuccaucagcuuuuguggagugaacucugacacaguuggcugguccuggcccgauggggccgagcugccuuucaccauugacaaauga

SEQ ID NO: 206355 - RNA, 1410 nt, Artificial Sequence; identical to SEQ ID NO: 206182
  derived and/or modified sequence opt5 from neuraminidase__InfluenzaA__AGE15480

SEQ ID NO: 206356 - RNA, 1410 nt, Artificial Sequence; identical to SEQ ID NO: 201224
  derived and/or modified sequence opt5 from neuraminidase__InfluenzaA__AGE89270

SEQ ID NO: 206357 - RNA, 1410 nt, Artificial Sequence; identical to SEQ ID NO: 201224
  derived and/or modified sequence opt5 from neuraminidase__InfluenzaA__AGE89280

SEQ ID NO: 206358 - RNA, 1410 nt, Artificial Sequence
  derived and/or modified sequence opt5 from neuraminidase__InfluenzaA__AGE89290
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguaucguggucaugacggacggauccgcuagcggcaaagccgauaccaagauccucuuuguugaggaagggaagauugugcauacauccacccugucuggaagcgcgcaacacguggaggaaugcuccugcuauccucgcuaccccggcgucagaugugugugccgggacaacuggaaagggagcaaucgcccuaucguugauauuaacaucaaggaccacucuauuaucuccagcuacguguguucuggacuugucggcgacacacccagaaagaaugauagcuccucuagcucccauugccuggacccgaacaaugaggaaggcgggcacggagugaagggcugggccuucgaugacgggaacgauguuuggaugggacggaccaucaaugagacgagccgccucggcuaugagacauuuaaagugauugaaggguggucuaacccuaaguccaaacugcagaucaauagacaggucauuguggaccggggaaaccgcagcggcuacucuggcaucuucuccgucgaggggaaaagcuguauuaauagaugcuuuuauguggaacugauccggggaagaaaggaggaaaccgagguucucuggaccuccaacucuauuguggucuucuguggcacaagcgggaccuacggaacaggcuccuggcccgauggggcugaccugaaucuuaugccuaucuga

SEQ ID NO: 206359 - RNA, 1410 nt, Artificial Sequence; identical to SEQ ID NO: 203281
  derived and/or modified sequence opt5 from neuraminidase__InfluenzaA__AGE89301

SEQ ID NO: 206360 - RNA, 1410 nt, Artificial Sequence
  derived and/or modified sequence opt5 from neuraminidase__InfluenzaA__AGE89311
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggaaaaacaauauccucagaacacaagagucugagugugcgugcgugaacggguccuguuucaccgugaugacggauggaccgagcgacggccaggccucuuacaagauuuuucggaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucggaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgagaugauuugggauccuaacggguggaccggaaccgacaauaacuuuagcaaaaagcaggacaucaucggcauuaaugaaugguccggguacucuggcagcuucgugcaacaucccgagcuuacaggacuggauuguauccgcccuugcuucugggucgaacucauuagaggccggcccaaagagaacacgaucuggaccuccgggagcucuauguccuuuuguggagugaauagcgacacaguuggcuggucuuggcccgauggggcugagcugccuuucaccauugacaaguga

SEQ ID NO: 206361 - RNA, 1410 nt, Artificial Sequence; identical to SEQ ID NO: 204811
  derived and/or modified sequence opt5 from neuraminidase__InfluenzaA__AGE89321

SEQ ID NO: 206362 - RNA, 1410 nt, Artificial Sequence; identical to SEQ ID NO: 204167
  derived and/or modified sequence opt5 from neuraminidase__InfluenzaA__AGE89332

SEQ ID NO: 206363 - RNA, 1410 nt, Artificial Sequence; identical to SEQ ID NO: 203281
  derived and/or modified sequence opt5 from neuraminidase__InfluenzaA__AGE89343

SEQ ID NO: 206364 - RNA, 1410 nt, Artificial Sequence
  derived and/or modified sequence opt5 from neuraminidase__InfluenzaA__AGE89353
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacauuaccaucgagaaggaaauuugcccuaaacucgcugaguaccggaauugguccaagccccagugugacaucacgggguucgccccuuuuucuaaagauaacagcauccgccuguccgcgggaggcgacauuugggugaccagagagcccuaugucucuugcgauccugacaaguguuaccaauucgcucuugggcagggaacaacccugaauaacgugcauagcaauaacacaguucgggaucgcaccccguauagaacgcuccugaugaaugaacugggcgugcccuuucaccucgggacaaagcaggucugcaucgccugguccagcagcuccugucaugacggaaaagccuggcugcacgugugcauuaccggcgaugacaagaacgcuacagccagcuucaucuacaauggccggcuuguugauucuguggucuccuggagcaaagagauucugcgcacccaggaaucugagugugugugcaucaacgggaccuguacaguggucaugacggacggauccgcuagcggcaaggccgauaccaaaauccucuuuauugaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacaccccggaagaaugauagcuccucuagcucccauugccuggacccgaacaaugaggaaggcgggcacggagugaaaggcugggccuucgaugacgggaacgauguuuggaugggacgcaccaucaaugagacgagcagacucggcuaugagacauuuaaggugauugaaggguggucuaacccuaaauccaagcugcagaucaaucggcaggucauuguggacaaaggaaaccgcagcggcuacucuggcaucuucuccgucgaggggaagucuuguauuaauagaugcuuuuauguggaacugauccggggaagaaaggaggaaaccgagguucucuggaccuccaacucuauuguggucuucuguggcacaagcgggaccuacggaacaggcuccuggcccgauggggcugaccugaaucuuaugccuaucuga

SEQ ID NO: 206365 - RNA, 1410 nt, Artificial Sequence; identical to SEQ ID NO: 204018
  derived and/or modified sequence opt5 from neuraminidase__InfluenzaA__AGE89364

SEQ ID NO: 206366 - RNA, 1410 nt, Artificial Sequence; identical to SEQ ID NO: 204811
  derived and/or modified sequence opt5 from neuraminidase__InfluenzaA__AGE89374

SEQ ID NO: 206367 - RNA, 1410 nt, Artificial Sequence
  derived and/or modified sequence opt5 from neuraminidase__InfluenzaA__AGE89385
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggcguccgucaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccauuaugacggauggaccgagcgacggccaggcuucuuacaaaaucuuucgcaucgaaaagggcaaaauugucaagagcguggagaugaaugcccccaacuaucauuacgaagagugcuccuguuacccugauucuagcgagaucacaugcgugugcagagacaauuggcacggguccaaccggcccuggguuagcuucaaucagaaccuggaauaucagauuggauacaucuguucuggcauuuuuggggauaauccucgccccaacgacaaaaccggauccugcggcccggugagcucuaauggggcuaacggagugaagggcuucuccuuuaaguauggcaacggggucuggaucggaagaacaaaaagcauuuccucucggaagggcuucgagaugaucugggauccuaauggguggaccggaaccgacaacaauuuuagcaucaaacaagacauugugggcaucaacgaaugguccggguacucuggcagcuucguucagcaucccgagcuuacaggacuggauuguauucgcccuugcuucuggguggaacucaucagaggccggcccaaggagaauacgauuuggaccuccgggagcucuaucuccuuuuguggagucaacagcgacacagugggcuggucuuggcccgauggggccgagcugccuuucaccaucgacaaauga

SEQ ID NO: 206368 - RNA, 1410 nt, Artificial Sequence
  derived and/or modified sequence opt5 from neuraminidase__InfluenzaA__AGE89395
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucuguggacauccaacucuaucguggucuucuguggcaccagcgggacauacggaacgggcuccuggccugauggggcugaccucaaucugaugcccauuuga

SEQ ID NO: 206369 - RNA, 1410 nt, Artificial Sequence; identical to SEQ ID NO: 201224
  derived and/or modified sequence opt5 from neuraminidase__InfluenzaA__AGE89425

SEQ ID NO: 206370 - RNA, 1410 nt, Artificial Sequence; identical to SEQ ID NO: 202542
  derived and/or modified sequence opt5 from neuraminidase__InfluenzaA__AGE89722

SEQ ID NO: 206371 - RNA, 1410 nt, Artificial Sequence
  derived and/or modified sequence opt5 from neuraminidase__InfluenzaA__AGE89733
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgaaugacggccaggccagcuacaaaaucuuucgcaucgaaaagggcaaaauugugaagucugucgagaugaacgcucccaauuaucauuacgaagagugcagcuguuacccugauuccucugagaucacaugcguuugcagagacaacuggcacgggagcaaucggcccuggguguccuucaaccagaaucuggaauaucagauuggauacaucuguagcggcauuuuuggggauaacccucgccccaaugacaaaaccggaucuugcggcccgguguccagcaacggggccaacggagucaagggcuucucuuuuaaguauggcaaugggguguggaucggaagaacaaaauccauuagcucccggaagggcuucgagaugaucugggauccuaacggguggaccggaaccgacaauaacuuuucuaucaaacaagacauuguuggcaucaaugaauggagcggguacuccggcucuuucgugcagcaucccgagcuuacaggacuggauuguauucgcccuugcuucugggucgaacucaucagaggccggcccaaggagaacacgauuuggaccagcggguccagcaucucuuuuuguggaguuaauuccgacacagugggcuggagcuggcccgauggggcugagcugccuuucaccaucgacaaauga

SEQ ID NO: 206372 - RNA, 1410 nt, Artificial Sequence
  derived and/or modified sequence opt5 from neuraminidase__InfluenzaA__AGE89743
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucguggacaaagauaaccgcagcggauacucuggcauuuucuccgucgagggcaagagcuguaucaauagaugcuuuuauguggaacugauucgggggagaaaggaggaaaccgagguucucuggacauccaacucuaucguggucuucuguggaaccagcggcacauacgggacgggauccuggcccgacggcgcugaucugaaucuuaugccuauuuga

SEQ ID NO: 206373 - RNA, 1410 nt, Artificial Sequence; identical to SEQ ID NO: 204811
  derived and/or modified sequence opt5 from neuraminidase__InfluenzaA__AGE89754

SEQ ID NO: 206374 - RNA, 1410 nt, Artificial Sequence; identical to SEQ ID NO: 204811
  derived and/or modified sequence opt5 from neuraminidase__InfluenzaA__AGE89765

SEQ ID NO: 206375 - RNA, 1410 nt, Artificial Sequence
  derived and/or modified sequence opt5 from neuraminidase__InfluenzaA__AGG13414
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauagcgugcauuccaacaauaccguucgggaucgcacgcccuauagaacacugcucaugaacgaacugggcgugccuuuucaccuggggaccaagcaggucugcauugccuggagcagcuccagcugucaugacggaaaagccuggcuccacgugugcaucacaggcgaugacaagaaugcuaccgccucuuucauuuacaacggccggcugguugauuccguggucagcuggucuaaagagauccuucgcacccaggaauccgagugugugugcauuaaugggacauguacgguggucaugaccgacggaagcgcuuccggcaaggccgauacaaaaauccuguuuaucgaggaagggaagauuguucauaccucuacacucagcggauccgcgcaacacguggaggaaugcagcugcuaucccagauacccuggcgugcggugugucugccgcgacaacuggaaggggucuaacagacccaucguggauauuaauaucaaagaccacuccauuguuagccgguacguguguucuggacuggucggcgacaccccgcgcaagaacgauagcuccucuagcucccauugccuugacccuaauaacgaggaaggcgggcacggagugaaaggcugggccuucgaugacgggaaugauguuuggaugggaagaacgaucaacgagacaagccggcugggcuaugagaccuuuaaggugaucgaaggguggucuaaucccaaauccaagcuccagauuaacaaacaggucaucguggaccgcggagauagaagcggcuacucuggcauuuucuccgucgaggggaagucuuguaucaaucggugcuuuuauguggaacugauuagaggacgcaaggaggaaaccgagguucuguggacauccaacucuaucguggucuucuguggcaccagcgggacauacggaacgggcuccuggccugacggggcugaucucaaucugaugcccauuuga

SEQ ID NO: 206376 - RNA, 1410 nt, Artificial Sequence; identical to SEQ ID NO: 205170
  derived and/or modified sequence opt5 from neuraminidase__InfluenzaA__AGG13426

SEQ ID NO: 206377 - RNA, 1410 nt, Artificial Sequence; identical to SEQ ID NO: 205170
  derived and/or modified sequence opt5 from neuraminidase__InfluenzaA__AGG13438

SEQ ID NO: 206378 - RNA, 1410 nt, Artificial Sequence
  derived and/or modified sequence opt5 from neuraminidase__InfluenzaA__AGG13498
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacaugugcuguggucaugacggauggauccgccagcggcaaggcggacaccaaaauccucuuuaucgaggaggggaagauuguucauacauccacccugucuggaagcgcccaacacguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacaccccggaagaaugacagcuccucuagcggccauugccuggauccgaacaaugaagagggaggacacggcgugaaagggugggcuuucgacgauggaaacgacguuuggaugggccgcaccaucaaugaaacguccagacucggguaugagacauuuaaggugaucgagggauggagcaacccuaaaucuaagcugcagauuaaucggcaggucaucguggaucgcggcaacagauccggcuacagcgggauuuucucugucgaagggaaaaauuguaucaaccggugcuuuuauguggagcugauuagaggccgcaaggaagagaccgaaguucucuggaccuccaauagcaucguggucuucugugggacauccggaaccuacggcacagggucuuggcccgacggcgccgaucugaaccuuaugccuauuuga

SEQ ID NO: 206379 - RNA, 1410 nt, Artificial Sequence; identical to SEQ ID NO: 205170
  derived and/or modified sequence opt5 from neuraminidase__InfluenzaA__AGG13510

SEQ ID NO: 206380 - RNA, 1410 nt, Artificial Sequence; identical to SEQ ID NO: 206378
  derived and/or modified sequence opt5 from neuraminidase__InfluenzaA__AGG13522

SEQ ID NO: 206381 - RNA, 1410 nt, Artificial Sequence
  derived and/or modified sequence opt5 from neuraminidase__InfluenzaA__AGG13534
augaaccccaaucagaagaucauuaccaucggcagcgugucccugacaauuucuacggucugcuucuuuaugcaaaucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauucgccucuccgcgggcggggauaucugggucacaagagagccuuaugugucuugcgacccggauaaguguuaccaauucgcucugggacagggcaccacacuuaauaacguucauagcaauaacaccgugcgggaccgcacgcccuauagaacacugcucaugaaugaacugggggucccuuuucaccugggaaccaaacaggugugcaucgccugguccucuagcuccugucaugauggcaaggccuggcuccacguuugcauuacaggcgacgauaagaacgcuaccgccagcuucaucuacaaugggcggcugguggacucugucguguccuggagcaaagagauucuucgcacccaggaaucugagugugugugcaucaacggaacauguacggucguuaugaccgauggcuccgcuagcgggaaggccgacacaaaaauucuguuuaucgaggaaggaaagaucgugcauaccuccacacucucuggcagcgcgcaacacguggaggaaugcuccugcuaucccagauacccugggguccggugugugugccgcgauaacuggaagggaagcaauagacccauuguugacaucaacauuaaagaucacucuaucguguccagcuacgucuguucuggccuggugggcgacaccccgcggaagaaugacagcuccucuagcucccauugccuugauccuaacaaugaggaagggggacacggcguuaaagggugggccuucgacgauggaaacgacguguggaugggccgcacgauuaaugagacaagcagacugggguaugagaccuuuaaggucaucgaaggauggucuaaccccaaauccaagcuccagaucaaucgccaggugauugucgaucggggcgacagaagcggcuacucugggaucuucuccguggagggaaaaagcuguauuaaccggugcuuuuauguugaacugaucagaggccgcaaggaggaaaccgaggugcuguggacauccaauucuauugucguguucugugggaccagcggaacauacggcacgggguccuggccugauggcgcugaccucaaccugaugcccaucuga

SEQ ID NO: 206382 - RNA, 1410 nt, Artificial Sequence
  derived and/or modified sequence opt5 from neuraminidase__InfluenzaA__AGG13546
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggagaggaagcaaucggcccaucguggacauuaacaucaaggaucacucuauuguuuccagcuacguguguucuggccuggucggcgacaccccgcgcaaaaaugacagcuccucuagcucccauugccuugauccuaacaaugaggaagggggacacggcgugaaggggugggccuucgacgauggaaacgacguuuggaugggcagaacgaucaaugagacaagccggcugggguaugagaccuuuaaagugaucgaaggauggucuaaccccaaguccaaacuccagauuaaucgccaggucaucguggauagaagcgaccggucuggcuacuccggcauuuucagcgucgaggggaaguccuguaucaacagaugcuuuuauguggaacugauucgcggacggaaagaggaaaccgagguucuguggacaucuaauagcaucguggucuucuguggcaccuccgggacauacggaacgggcucuuggccugauggggcugaccucaaccugaugcccauuuga

SEQ ID NO: 206383 - RNA, 1410 nt, Artificial Sequence; identical to SEQ ID NO: 205170
  derived and/or modified sequence opt5 from neuraminidase__InfluenzaA__AGG13558

SEQ ID NO: 206384 - RNA, 1410 nt, Artificial Sequence; identical to SEQ ID NO: 205170
  derived and/or modified sequence opt5 from neuraminidase__InfluenzaA__AGG13570

SEQ ID NO: 206385 - RNA, 1410 nt, Artificial Sequence
  derived and/or modified sequence opt5 from neuraminidase__InfluenzaA__AGG13582
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgaggacaagaacgcuaccgccagcuucauuuacaaugggcggcugguugauucuguggucuccuggagcaaagaaacccuucgcacacaggagucugagugugugugcaucaacggaacguguaccguggucaugacagacggcuccgcuagcgggaaggccgauaccaaaauucuguuuaucgaagagggaaagaucguucauacauccacccucucuggcagcgcgcaacacguggaagagugcuccugcuaucccagauacccuggggugcggugugucugccgcgacaacuggaagggaagcaauagacccauuguggauaucaacauuaaagaccacucuaucguuuccagcuacguguguucuggccuggucggcgauacgccgcggaagaaugacagcuccucuagcucccauugccuugacccuaacaaugaagaagggggacacggcgugaaagggugggccuucgaugacggaaacgauguuuggaugggccgcacaauuaaugagaccagcagacugggguaugagaccuuuaaggugaucgagggauggucuaaccccaaauccaagcuccagaucaaucggcaggucauuguggaccgcggcgauagaagcggcuacucugggaucuucuccgucgaaggaaaaagcuguauuaaccggugcuuuuauguggagcugaucagaggccgcaaggaagagacagagguucuguggaccuccaauucuauuguggucuucugugggacaagcggaacguacggcaccggguccuggccugacggcgcugaucucaaccugaugcccaucuga

SEQ ID NO: 206386 - RNA, 1410 nt, Artificial Sequence; identical to SEQ ID NO: 205170
  derived and/or modified sequence opt5 from neuraminidase__InfluenzaA__AGG13606

SEQ ID NO: 206387 - RNA, 1410 nt, Artificial Sequence
  derived and/or modified sequence opt5 from neuraminidase__InfluenzaA__AGG13618
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuaccuguguucuggccuugugggcgacaccccgcggaagaaugacgggagcuccucuagccauugccuggauccuaacaaugaggaaggaggccacggggucaaaggaugggccuucgacgauggcaacgacguguggauggggcgcacgaucaaugagacauccagacucggauaugagaccuuuaagguuaucgaaggcuggagcaaccccaaaucuaagcugcagauuaaucggcagaucauuguggaucgcggcgacagauccggguacagcggaaucuucucugucgagggcaaauccuguauuaaccggugcuuuuauguggaacugaucagagggcgcaaggaggaaaccgagguccucuggacaagcaauuccauugugguuuucuguggaaccucuggcacauacgggacgggcagcuggccugauggagcugaccugaaccuuaugcccaucuga

SEQ ID NO: 206388 - RNA, 1410 nt, Artificial Sequence
  derived and/or modified sequence opt5 from neuraminidase__InfluenzaA__AGG13630
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgaggacaagaacgcuaccgccagcuucauuuacaaugggcggcugguugauucuguggucuccuggagcaaagaaauccuucgcacccaggagucugagugugugugcauuaacggaacauguacgguggucaugaccgacggcuccgcuagcgggaaggccgauacaaaaauccuguuuaucgaagagggaaagauuguucauaccuccacacucucuggcagcgcgcaacacguggaagagugcuccugcuaucccagauacccuggggugcggugugucugccgcgacaacuggaagggaagcaauagacccaucguggauauuaacaucaaagaccacucuauuguuuccagcuacguguguucuggccuggucggcgauaccccgcggaagaaugacagcuccucuagcucccauugccuugacccuaacaaugaagaagggggacacggcgugaaagggugggccuucgaugacggaaacgauguuuggaugggccgcacgaucaaugagacaagcagacugggguaugagaccuuuaaggugaucgagggauggucuaaccccaaauccaagcuccagauuaaucggcaggucaucguggaccgcggcgauagaagcggcuacucugggauuuucuccgucgaaggaaaaagcuguaucaaccggugcuuuuauguggagcugauuagaggccgcaaggaagagaccgagguucuguggacauccaauucuaucguggucuucugugggaccagcggaacauacggcacgggguccuggccugacggcgcugaucucaaccugaugcccauuuga

SEQ ID NO: 206389 - RNA, 1410 nt, Artificial Sequence; identical to SEQ ID NO: 205170
  derived and/or modified sequence opt5 from neuraminidase__InfluenzaA__AGG13642

SEQ ID NO: 206390 - RNA, 1410 nt, Artificial Sequence
  derived and/or modified sequence opt5 from neuraminidase__InfluenzaA__AGG13654
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacaugugcuguggucaugacggauggauccgccagcggcaaggcggacaccaaaauccucuuuaucgaggaggggaagauuguucaaacauccacccugucuggaagcgcccagcauguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacaccccggaagaaugacagcuccucuagcggccacugccuggauccgaacaaugaagagggaggacauggcgugaaagggugggcuuucgacgauggaaacgacguuuggaugggccgcaccaucaaugaaacguccagacucggguaugagacauuuaaggugaucgagggauggagcaacccuaaaucuaagcugcagauuaaucggcaggucaucguggaucgcggcaacagauccggcuacagcgggauuuucucugucgaagggaaaaauuguaucaaccggugcuuuuauguggagcugauuagaggccgcaaggaagagaucgaaguucucuggaccuccaauagcauuguggucuucugugggaccuccggaacauacggcaccgggucuuggcccgacggcgccgaucugaaccuuaugccuaucuga

SEQ ID NO: 206391 - RNA, 1410 nt, Artificial Sequence; identical to SEQ ID NO: 206381
  derived and/or modified sequence opt5 from neuraminidase__InfluenzaA__AGG13666

SEQ ID NO: 206392 - RNA, 1410 nt, Artificial Sequence
  derived and/or modified sequence opt5 from neuraminidase__InfluenzaA__AGG13678
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcgccccucucuaaagacaacagcauccgccuguccgccggcggggauaucugggugacaagagagccuuaugucucuugcgacccggauaaguguuaccaauuugcucuuggacagggcaccacacugaauaacgugcauagcaauaacaccguucgggaccgcacgcccuauagaacacuccugaugaaugaacugggggugccuuuccaccucggaaccaagcaggucugcauugccugguccuccucuuccugucaugauggcaaagccuggcugcacgugugcaucacaggcgacgauaagaacgcuaccgccagcuuuauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuucaucgaggaaggaaagauuguucauaccuccacacugucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuugucggcgacaccccgcggaagaaugacagcuccucuagcucccauugccuggggccuaacaaugaggaaggaggccacggggugaaaggaugggccuuugaugacggcaacgauguuuggauggggcgcacgaucaaugagacaagcagacucggauaugagaccuucaaggugaucgaaggcuggucuaaccccaaauccaagcugcagauuaaucggcaggucaucguggaccgcggcgauagaagcggguacucuggaauuuuuagcgucgagggcaaaagcuguaucaaccggugcuucuauguggaacugauuagagggcgcaaggaggaaaccgagguucucuggacauccaauucuaucguggucuuuuguggaaccgcuggcacauacgggacgggcagcuggccugacggagccgaucugaaccuuaugcccauuuga

SEQ ID NO: 206393 - RNA, 1410 nt, Artificial Sequence; identical to SEQ ID NO: 205170
  derived and/or modified sequence opt5 from neuraminidase__InfluenzaA__AGG13690

SEQ ID NO: 206394 - RNA, 1410 nt, Artificial Sequence
  derived and/or modified sequence opt5 from neuraminidase__InfluenzaA__AGG13702
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaaacgcgcaacacguggaggaaugcagcugcuaucccagauacccuggcgugcggugugucugccgcgacaauuggaagggguccaacagacccaucguggauauuaauaucaaagaccacagcauuguuucucgguacguguguuccggacuggucggcgacaccccgcgcaagaacgauagcucuagcuccucucauugccuugacccuaauaacgaggaaggcgggcacggagugaaaggcugggccuucgaugacgggaaugauguuuggaugggaagaacgaucaacgagacaagccggcugggcuaugagaccuuuaaggugaucgaagggugguccaaucccaaaagcaagcuccagauuaaccgccaggucaucguggacagaggagaucggucuggcuacuccggcauuuucagcgucgaggggaaaucuuguaucaauagaugcuuuuauguggaacugauucgcggacggaaggaggaaaccgagguucuguggacauccaacagcaucguggucuucuguggcaccuccgggacauacggaacgggcucuuggccugacggggcugaucucaaucugaugcccauuuga

SEQ ID NO: 206395 - RNA, 1410 nt, Artificial Sequence; identical to SEQ ID NO: 206378
  derived and/or modified sequence opt5 from neuraminidase__InfluenzaA__AGG13714

SEQ ID NO: 206396 - RNA, 1410 nt, Artificial Sequence; identical to SEQ ID NO: 205170
  derived and/or modified sequence opt5 from neuraminidase__InfluenzaA__AGG13726

SEQ ID NO: 206397 - RNA, 1410 nt, Artificial Sequence; identical to SEQ ID NO: 205170
  derived and/or modified sequence opt5 from neuraminidase__InfluenzaA__AGG13738

SEQ ID NO: 206398 - RNA, 1410 nt, Artificial Sequence; identical to SEQ ID NO: 205170
  derived and/or modified sequence opt5 from neuraminidase__InfluenzaA__AGG13750

SEQ ID NO: 206399 - RNA, 1410 nt, Artificial Sequence
  derived and/or modified sequence opt5 from neuraminidase__InfluenzaA__AGG13762
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuucccgguacguguguagcggacuggucggcgacaccccgcgcaagaaugauucuagcuccucuagccauugccuugacccuaacaaugaggaaggcgggcacggagugaaaggcugggccuucgaugacgggaacgauguuuggaugggaagaacgaucaaugagacaucccggcugggcuaugagaccuuuaaggugaucgaaggguggagcaaccccaaaucuaagcuccagauuaaucgccaggucaucguggacagaggagaucgguccggcuacagcggcauuuucucugucgaggggaaauccuguaucaacagaugcuuuuauguggaacugauucgcggacggaaggaggaaaccgagguucuguggacaagcaauuccaucguggucuucuguggcaccucugggacauacggaacgggcagcuggccugacggggcugaucucaaccugaugcccauuuga

SEQ ID NO: 206400 - RNA, 1410 nt, Artificial Sequence
  derived and/or modified sequence opt5 from neuraminidase__InfluenzaA__AGG13774
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaaccauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuguggucuccuggagcaaagacauucugcgcacacaggagucugaaugugugugcaucaacgggacgugugcuguggucaugaccgauggauccgccagcggcaaggcggacacaaaaauucucuuuaucgaggaggggaagaucguucauaccuccacacugucuggaagcgcccaacacguggaagagugcuccugcuauccuagauaccccggcgugcggugugucugccgcgauaacuggaaggggagcaauagaccuauuguggacaucaacauuaaagaccacucuaucguuuccagcuacguguguucuggacuugucggcgauacgccccggaagaaugacagcuccucuagcggccauugccuggauccgaacaaugaagagggaggacacggcgugaaagggugggcuuucgacgauggaaacgacguuuggaugggccgcaccauuaaugaaacauccagacucggguaugagaccuuuaaggugaucgagggauggagcaacccuaaaucuaagcugcagaucaaucggcaggucauuguggaucgcggcaacagauccggcuacagcgggaucuucucugucgaagggaaaaauuguauuaaccggugcuuuuauguggagcugaucagaggccgcaaggaagagaccgaaguucucuggacauccaauagcauuguggucuucugugggaccuccggaacauacggcacggggucuuggcccgacggcgccgaucugaaccuuaugccuaucuga

SEQ ID NO: 206401 - RNA, 1410 nt, Artificial Sequence
  derived and/or modified sequence opt5 from neuraminidase__InfluenzaA__AGG13786
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaaccugcauagcaauaacaccgugcgggaccgcacgcccuauagaacacuccugaugaaugaacuggggguuccuuuucaccucggaaccaaacaggugugcauugccugguccucuagcuccugucaugauggcaaggccuggcugcacgucugcaucacaggcgacgauaagaacgcuaccgccagcuucauuuacaaugggcggcuuguggacucuguuguguccuggagcaaagagauccugcgcacccaggaaucugagugugucugcauuaacggaacauguacgguggugaugaccgauggcuccgcuagcgggaaggccgacacaaaaauccucuuuaucgaggaaggaaagauuguccauaccuccacacugucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuugugggcgacaccccgcggaagaaugacagcuccucuagcucccauugccuggauccuaacaaugaggaagggggacacggcgucaaagggugggccuucgacgauggaaacgacguguggaugggccgcacgaucaaugagacaagcagacucggguaugagaccuuuaagguuaucgaaggauggucuaaccccaaauccaagcugcagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcucuggacauccaauucuaucguuguguucugugggaccagcggaacauacggcacgggguccuggccugauggcgcugaccugaaccuuaugcccauuuga

SEQ ID NO: 206402 - RNA, 1410 nt, Artificial Sequence; identical to SEQ ID NO: 206378
  derived and/or modified sequence opt5 from neuraminidase__InfluenzaA__AGG13798

SEQ ID NO: 206403 - RNA, 1410 nt, Artificial Sequence
  derived and/or modified sequence opt5 from neuraminidase__InfluenzaA__AGG13810
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuucccgguacguguguagcggacuggucggcgacaccccgcgcaagaaugauucuagcuccucuagccauugccuuggcccuaacaaugaggaagggggacacggcgugaaagggugggccuucgacgauggaaacgacguuuggaugggcagaacgaucaaugagacaucccggcugggguaugagaccuuuaaggugaucgaaggauggagcaaccccaaaucuaagcuccagauuaaucgccaggucaucguggauagaggcgaccgguccggcuacagcgggauuuucucugucgagggaaaauccuguaucaacagaugcuuuuauguggaacugauucgcggccggaaggaggaaaccgagguucuguggacaagcaauuccaucguggucuucugugggaccucuggaacauacggcacggggagcuggccugauggcgcugaccucaaccugaugcccauuuga

SEQ ID NO: 206404 - RNA, 1410 nt, Artificial Sequence; identical to SEQ ID NO: 206378
  derived and/or modified sequence opt5 from neuraminidase__InfluenzaA__AGG13822

SEQ ID NO: 206405 - RNA, 1410 nt, Artificial Sequence; identical to SEQ ID NO: 206378
  derived and/or modified sequence opt5 from neuraminidase__InfluenzaA__AGG13834

SEQ ID NO: 206406 - RNA, 1410 nt, Artificial Sequence; identical to SEQ ID NO: 206399
  derived and/or modified sequence opt5 from neuraminidase__InfluenzaA__AGG13846

SEQ ID NO: 206407 - RNA, 1410 nt, Artificial Sequence; identical to SEQ ID NO: 205170
  derived and/or modified sequence opt5 from neuraminidase__InfluenzaA__AGG13858

SEQ ID NO: 206408 - RNA, 1410 nt, Artificial Sequence
  derived and/or modified sequence opt5 from neuraminidase__InfluenzaA__AGG13870
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggaucgguguuaccaauucgcucugggacagggcaccacacuuaauaacaugcauagcaauaacaccgugcgcgacagaacgcccuaucggacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcgccugguggacucuguuguguccuggagcaaggagauccuuagaacccaggaaucugagugugucugcauuaacggaacauguacgguggugaugaccgauggcuccgcuagcgggaaagccgacacaaagauccuguuuaucgaggaaggaaaaauuguccauaccuccacacucucuggcagcgcgcaacacguugaggaaugcuccugcuauccccgguacccuggggugcgcugugugugcagagauaacuggaagggaagcaaucggcccaucgucgacauuaacaucaaggaucacucuauuguguccagcuacguuuguucuggccuggugggcgacaccccgcgcaaaaaugacagcuccucuagcucccauugccuugauccuaacaaugaggaagggggacacggcgucaaggggugggccuucgacgauggaaacgacguguggaugggcagaacgaucaaugagacaagccggcugggguaugagaccuuuaaaguuaucgaaggauggucuaaccccaaguccaaacuccagauuaaucgccaggugaucgucgauagaggcgaccggagcggcuacucugggauuuucuccguggagggaaccagcuguaucaacagaugcuuuuaugucgaacugauucgcggccggaaggaggaaacagaggugcuguggaccuccaauucuaucguuguguucugugggacaagcggaacguacggcaccggguccuggccugauggcgcugaccucaaccugaugcccauuuga

SEQ ID NO: 206409 - RNA, 1410 nt, Artificial Sequence
  derived and/or modified sequence opt5 from neuraminidase__InfluenzaA__AGG13894
augaaccccaaucagaagaucauuaccaucggcagcgugucccugacaauuucuacggucugcuucuuuaugcaaaucgccauucucaucaccacaguuacccugcacuucaaacaguacgaguuuaacagcccuccgaauaaccaggugaugcuuugugaacccacaaucauugagagaaaugugaccgaaaucgucuaucugacaaacaccacgauugagaaggaaaucugcccuaaacccgcugaguaccggaauugguccaagccucagugugggauuaccggauucgcccccuuuucuaaagacaacagcauccgccucuccgcgggcggggauauuugggugacaagagagccuuauguuucuugcgacccggauaaguguuaccaauucgcucugggacagggcaccacacuuaauaacgugcauagcaauaacaccguccgggaccgcacgcccuauagaacacugcucaugaaugaacugggggugccuuuucaccugggaaccaagcagguuugcaucgccugguccucuagcuccugucaugauggcaaagccuggcuccacgugugcaucacaggcgacgauaagaacgcuaccgccagcuucauuuacaaugggcggcuggucgacucugugguguccuggagcaaagagauccuucgcacccaggaaucugagugugucugcauuaacggaacauguacgguugugaugaccgauggcuccgcuagcgggaaggccgacacaaaaauccuguuuauugaggaaggaaagaucgugcauaccuccacacucucuggcagcgcgcaacacgucgaggaaugcuccugcuaucccagauacccuggggugcgguguguuugccgcgauaacuggaagggaagcaauagacccaucguggacauuaacaucaaagaucacucuauugucuccagcuacguguguucuggccugguuggcgacaccccgcggaagaaugacagcuccucuagcucccauugccuugauccuaacaaugaggaagggggacacggcgugaaagggugggccuucgacgauggaaacgacgucuggaugggccgcacgaucaaugagacaagcagacugggguaugagaccuuuaaggugauugaaggauggucuaaccccaaauccaagcuccagaucaaucggcaggucaucguggaucgcggcgacagaagcggcuacucugggauuuucuccguugagggaaaaagcuguaucaaccggugcuuuuauguggaacugauuagaggccgcaaggaggaaaccgagguccuguggacauccaauucuaucgugguuuucugugggaccagcggaacauacggcacgggguccuggccugauggcgcugaccucaaccugaugcccauuuga

SEQ ID NO: 206410 - RNA, 1410 nt, Artificial Sequence; identical to SEQ ID NO: 206378
  derived and/or modified sequence opt5 from neuraminidase__InfluenzaA__AGG13906

SEQ ID NO: 206411 - RNA, 1410 nt, Artificial Sequence
  derived and/or modified sequence opt5 from neuraminidase__InfluenzaA__AGG13930
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugaccgcagcuccucuagccauugccuugauccuaacaaugaggaagggggacacggcgugaaagggugggccuucgacgauggaaacgacguuuggaugggcagaacgaucaaugagacaucccggcugggguaugagaccuuuaaggugaucgaaggauggagcaaccccaaaucuaagcuccagauuaaucgccaggucaucguggauagaggcgaccgguccggcuacagcgggauuuucucugucgagggaaaauccuguaucaacagaugcuuuuauguggaacugauucgcggccggaaggaggaaaccgagguucuguggacaagcaauuccaucguggucuucugugggaccucuggaacauacggcacggggagcuggccugauggcgcugaccucaaccugaugcccauuuga

SEQ ID NO: 206412 - RNA, 1410 nt, Artificial Sequence; identical to SEQ ID NO: 206388
  derived and/or modified sequence opt5 from neuraminidase__InfluenzaA__AGG13942

SEQ ID NO: 206413 - RNA, 1410 nt, Artificial Sequence
  derived and/or modified sequence opt5 from neuraminidase__InfluenzaA__AGG13965
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagaugaaugcucccaacuaucauuacgaagagugcagcuguuacccugauuccagcgagauuacaugcgugugcagagacaauuggcacgggucuaaccggcccuggguguccuucaaucagaaccuggaauaucagaucggauacauuuguagcggcaucuuuggggauaauccucgccccaacgacaaaaccggaucuugcggcccggucuccagcaauggggccaacggagugaagggcuucuccuuuaaguauggcaaugggguuuggauuggaagaacaaaaucuaucagcucccggaagggcuucgagaugauuugggauccuaacggguggaccggaaccgacaacaauuuuucuaucaaacaagacaucgugggcauuaacgaauggagcggguacuccggcagcuucguccagcaucccgagcuuacaggacuggauuguauccgcccuugcuucuggguggaacucauuagaggccggcccaaggagaauacgaucuggaccucuggguccagcauuucuuuuuguggaguuaacuccgacacagugggcuggagcuggcccgauggggcugagcugccuuucaccaucgacaaauga

SEQ ID NO: 206414 - RNA, 1410 nt, Artificial Sequence; identical to SEQ ID NO: 206381
  derived and/or modified sequence opt5 from neuraminidase__InfluenzaA__AGG13976

SEQ ID NO: 206415 - RNA, 1410 nt, Artificial Sequence; identical to SEQ ID NO: 206381
  derived and/or modified sequence opt5 from neuraminidase__InfluenzaA__AGG13988

SEQ ID NO: 206416 - RNA, 1410 nt, Artificial Sequence; identical to SEQ ID NO: 206381
  derived and/or modified sequence opt5 from neuraminidase__InfluenzaA__AGG14000

SEQ ID NO: 206417 - RNA, 1410 nt, Artificial Sequence; identical to SEQ ID NO: 206381
  derived and/or modified sequence opt5 from neuraminidase__InfluenzaA__AGG14012

SEQ ID NO: 206418 - RNA, 1410 nt, Artificial Sequence; identical to SEQ ID NO: 206399
  derived and/or modified sequence opt5 from neuraminidase__InfluenzaA__AGG14024

SEQ ID NO: 206419 - RNA, 1410 nt, Artificial Sequence
  derived and/or modified sequence opt5 from neuraminidase__InfluenzaA__AGG14036
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacaugugcuguggucaugacggauggauccgccagcggcaaggcggacaccaaaauccucuuuaucgaggaggggaagauuguucauacauccacccugucuggaagcgcccaacacguggaagagugcuccugcuauccuagauaccccggcgugcggugugucugccgcgauaacuggaaggggagcaauagaccuaucguggacauuaacaucaaagaccacucuauuguuuccagcuacauguguucuggacuugugggcgauacaccccggaagaaugacagcuccucuagcggccauugccuggauccgaacaaugaagagggaggacacggcgucaaagggugggcuuucgacgauggaaacgacguguggaugggccgcaccaucaaugaaacguccagacucggguaugagacauuuaagguuaucgagggauggagcaacccuaaaucuaagcugcagauuaaucgccaggugaucgucgaucggggcaacagauccggcuacagcgggauuuucucuguggaagggaaaaauuguaucaaccggugcuuuuaugucgagcugauuagaggccgcaaggaagagaccgaagugcucuggaccuccaauagcaucguuguguucugugggacauccggaaccuacggcacagggucuuggcccgacggcgccgaucugaaccuuaugccuauuuga

SEQ ID NO: 206420 - RNA, 1410 nt, Artificial Sequence; identical to SEQ ID NO: 206399
  derived and/or modified sequence opt5 from neuraminidase__InfluenzaA__AGG14321

SEQ ID NO: 206421 - RNA, 1410 nt, Artificial Sequence; identical to SEQ ID NO: 205170
  derived and/or modified sequence opt5 from neuraminidase__InfluenzaA__AGG14333

SEQ ID NO: 206422 - RNA, 1410 nt, Artificial Sequence; identical to SEQ ID NO: 204811
  derived and/or modified sequence opt5 from neuraminidase__InfluenzaA__AGG84182

SEQ ID NO: 206423 - RNA, 1398 nt, Artificial Sequence
  derived and/or modified sequence opt5 from neuraminidase__InfluenzaA__AGJ51955
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccguccgcauuggggagagcuccgauguucuggugaccagagaacccuaugugucuugcgacccugaugagugucgguuuuacgcccucagccagggaacaaccauccgcggcaagcauuccaacggcacaauccacgacagaagccaauaucgggcucugauuucuuggccccuguccagcccucccaccgucuacaacucucgcguggagugcaucgggugguccagcacgucuugucaugauggaaaauccagaaugagcauuugcaucuccggcccuaauaacaaugccucugcuguugugugguauaaccggcgcccggucgccgaaauuaauacaugggcgagaaacauccuccggacccaggagagcgaaugugugugccacaaugggguuugucccguggucuucacagacggauccgccaccggcccugcugauacccgcaucuacuacuuuaaggaggggaagauucugaaaugggagagccuuacaggaacggccaagcacaucgaagagugcucuugcuauggcgaaagaaccggcauuacauguaccugccgggacaacuggcagggguccaaucgccccgugauccagauugauccuguggcuaugacacauaccagccaauacaucuguucucccguccugacggacaacccgagaccuaaugaucccaacaucggaaaaugcaaugacccuuaucccggcaacaauaacaacgggguuaagggauucagcuaccucgauggcgccaauacauggcuggggcggaccauuuccaccgcgucuagaagcggauaugagaugcuuaaagugcccaacgcccugacagacgaccgcuccaagccuauccagggccagaccauugugcucaaugcugauuggagcggcuacucuggguccuuuauggacuauugggccgaaggagauuguuaccgggcuugcuucuacgucgagcugaucagaggccgcccgaaggaggacaaagugcuguggacaggggauagcauuguuucuauguguuccagcacggaauuucucggacaguggaacuggcccgacggcgccaagaucgaguauuuccuguga

SEQ ID NO: 206424 - RNA, 1398 nt, Artificial Sequence
  derived and/or modified sequence opt5 from neuraminidase__InfluenzaA__AGJ72863
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccguccgcauuggggagagcuccgauguucuggugaccagagaacccuaugugucuugcgacccugaugagugucgguuuuacgcccucagccagggaacaaccauccgcggcaagcauuccaacggcacaauccacgacagaagccaauaucgggcucugauuucuuggccccuguccagcccucccaccgucuacaacucucgcguggagugcaucgggugguccagcacgucuugucaugauggaaaauccagaaugagcauuugcaucuccggcccuaauaacaaugccucugcuguugugugguauaaccggcgcccggucgccgaaauuaauacaugggcgagaaacauccuccggacccaggagagcgaaugugugugccacaaugggguuugucccguggucuucacagacggauccgccaccggcccugcugauacccgcaucuacuacuuuaaggaggggaagauucugaaaugggagagccuuacaggaacggccaagcacaucgaagagugcucuugcuauggcgaaagaaccggcauuacauguaccugccgggacaacuggcagggguccaaucgccccgugauccagauugauccuguggcuaugacacauaccagccaauacaucuguucucccguccugacggacaacccgagaccuaaugaucccaacaucggaaaaugcaaugacccuuaucccggcaacaauaacaacgggguuaagggauucagcuaccucgauggcgccaauacauggcuggggcggaccauuuccaccgcgucuagaagcggauaugagaugcuuaaagugcccaacgcccugacagacgaccgcuccaagccuauccagggccagaccauugugcucaaugcugauuggagcggcuacucuggguccuuuauggacuauugggccgaaggagauuguuaccgggcuugcuucuacgucgaggugaucagaggccgcccgaaggaggacaaaguuuggugggccgggaacagcauugugucuauguguuccagcacagaauuucugggacaguggaauuggcccgauggcgccaagaucgaguauuuccuguga

SEQ ID NO: 206425 - RNA, 1410 nt, Artificial Sequence
  derived and/or modified sequence opt5 from neuraminidase__InfluenzaA__AGJ73328
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagaugaaugcucccaacuaucauuacgaagagugcagcuguuacccugauuccagcgagauuacaugcgugugcagagacaauuggcacgggucuaaccggcccuggguguccuucaaucagaaccuggaauaucagaucggauacauuuguagcggcaucuuuggggauaauccucgccccaacgacaaaaccggaucuugcggcccggucuccagcaauggggccaacggagugaagggcuucuccuuuaaguauggcaaugggguuuggauuggaagaacaaaaucuaucagcucccggaagggcuucgagaugauuugggauccuaacggguggaacggaaccgacaauaacuuuucuaucaaacaagacaucgugggcauuaaugaauggagcggguacuccggcagcuucguccagcaucccgagcuuaccggacuggauuguauccgcccuugcuucuggguggaacucauuagaggccggcccaaggagaacacaaucuggacgucuggguccagcauuucuuuuuguggaguuaauuccgacaccgugggcuggagcuggcccgauggggcugagcugccuuucacaaucgacaaauga

SEQ ID NO: 206426 - RNA, 1410 nt, Artificial Sequence; identical to SEQ ID NO: 203281
  derived and/or modified sequence opt5 from neuraminidase__InfluenzaA__AGJ73330

SEQ ID NO: 206427 - RNA, 1410 nt, Artificial Sequence
  derived and/or modified sequence opt5 from neuraminidase__InfluenzaA__AGJ73332
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucauaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaggacaucauuggcaucaaugaaugguccggguacucuggcagcuucgugcaacaccccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 206428 - RNA, 1410 nt, Artificial Sequence; identical to SEQ ID NO: 203281
  derived and/or modified sequence opt5 from neuraminidase__InfluenzaA__AGJ73334

SEQ ID NO: 206429 - RNA, 1410 nt, Artificial Sequence; identical to SEQ ID NO: 203281
  derived and/or modified sequence opt5 from neuraminidase__InfluenzaA__AGJ73336

SEQ ID NO: 206430 - RNA, 1410 nt, Artificial Sequence; identical to SEQ ID NO: 203281
  derived and/or modified sequence opt5 from neuraminidase__InfluenzaA__AGJ73338

SEQ ID NO: 206431 - RNA, 1410 nt, Artificial Sequence
  derived and/or modified sequence opt5 from neuraminidase__InfluenzaA__AGJ73340
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccugcuagcggcugggccauuuacucuaaggacaauuccaucagaaucgggagcaaaggagauguuuuugugauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggucccuagccccuacaacucccgcuuugaaucuguggcuuggagcgccuccgcuugccacgacggaauuaacuggcugaccaucggcaucagcgggccugauaauggagccguugcggugcugaaguauaacggcauuaucacagacaccauuaagucuuggagaaauaacauccuccggacacaagaguccgagugugccugcgucaaugggagcuguuucaccauuaugacggauggaccgucugacggccaggcuagcuacaaaaucuuucgcaucgaaaagggcaaaauugugaaguccguggagaugaacgcccccaauuaucauuacgaagagugcucuuguuacccugauagcuccgagaucacaugcgucugcagagacaacuggcacgggagcaaucggcccuggguuucuuucaaccagaaucuggaauaucagauuggauacaucuguuccggcauuuuuggggauaacccucgccccaaugacaaaaccggaagcugcggcccggugucuuccaacggggcuaauggagugaagggcuucagcuuuaaguauggcaacggggucuggaucggaagaacaaaauccauuucuagccggaagggcuucgagaugaucugggauccuaacggguggaccggaaccgacaauaacuuuuccaucaaacaagacauugugggcaucaaugaauggucuggguacagcggcuccuucguucagcaucccgagcuuacaggacuggauuguauucgcccuugcuucuggguggaacucaucagaggccggcccaaggagaacacgauuuggaccagcgggucuuccaucagcuuuuguggagucaauucugacacagugggcugguccuggcccgauggggccgagcugccuuucaccaucgacaaauga

SEQ ID NO: 206432 - RNA, 1410 nt, Artificial Sequence
  derived and/or modified sequence opt5 from neuraminidase__InfluenzaA__AGJ73342
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccauuaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaagggcuucgagaugaucugggauccuaacggguggaccggaaccgacaauaacuuuuccaucaaacaagacauuguuggcaucaaugaauggucuggguacagcggcuccuucgugcagcaucccgagcuuacaggacuggauuguauucgcccuugcuucugggucgaacucaucagaggccggcccaaggagaacacgauuuggaccagcgggucuuccaucagcuuuuguggaguuaauucuggcacaguggggugguccuggcccgacggagcugagcugccuuucaccaucgauaaauga

SEQ ID NO: 206433 - RNA, 1410 nt, Artificial Sequence; identical to SEQ ID NO: 203733
  derived and/or modified sequence opt5 from neuraminidase__InfluenzaA__AGJ73344

SEQ ID NO: 206434 - RNA, 1410 nt, Artificial Sequence
  derived and/or modified sequence opt5 from neuraminidase__InfluenzaA__AGJ73346
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagaaauguaaccaauccgucauuacguacgaaaauaacaccuggguuaaucagacauaugugaacaucucuaauaccaacuucgcugccgggcagagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcacauuuuuccugacccagggcgcccuucugaaugacaaacauuccaacggcacaauuaaggauagaagcccuuaucggacccucaugucuugucccaucggggaggugccuucccccuacaacagccgcuuugaauccguugccuggucugcuagcgccugccacgacggaauuaauuggcugacgaucggcaucuccgggccugauaacggagcuguggccguccugaaguauaauggcauuaucaccgacacaauuaaaagcuggagaaacaauauccuccggacccaagagucugagugugcgugcgugaacggguccuguuucacaauuaugaccgauggaccgagcgacggccaggccucuuacaagaucuuucgcaucgaaaaaggcaagauugugaaaagcgucgagaugaaugcucccaacuaucauuacgaagagugcuccuguuacccugauucuagcgagaucacgugcguuugcagagacaauuggcacggguccaaccggcccugggugagcuucaaucagaaccuggaauaucagauuggauacaucuguucuggcauuuuuggggauaauccucgccccaacgacaagacaggauccugcggcccggugagcucuaauggggccaacggagucaagggcuucuccuuuaaauauggcaacgggguguggaucggaagaaccaagagcauuuccucucggaaaggcuucgagaugaucugggauccuaauggguggacaggaaccgacaacaauuuuagcaucaagcaagacauuguuggcaucaacgaaugguccggguacucuggcagcuucgugcagcaucccgagcuuaccggacuggauuguauucgcccuugcuucugggucgaacucaucagaggccggcccaaagaguccacaauuuggacgagcgggucuuccaucagcuuuuguggaguuaauucugacaccgugggcugguccuggcccgauggggcugagcugccuuucacaaucgacaaguga

SEQ ID NO: 206435 - RNA, 1410 nt, Artificial Sequence
  derived and/or modified sequence opt5 from neuraminidase__InfluenzaA__AGJ73348
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcgugauuuccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccaucaugacggauggaccgagcgacggccaggccucuuacaaaaucuuucgcauugaaaagggcaaaaucgucaagagcguggagaugaaugcucccaacuaucauuacgaagagugcuccuguuacccugauucuagcgagauuacaugcgugugcagagacaauuggcacggguccaaccggcccuggguuagcuucaaucagaaccuggaauaucagaucggauacauuuguucuggcaucuuuggggauaauccucgccccaacgacaaaaccggauccugcggcccggugagcucuaauggggccaacggagugaagggcuucuccuuuaaguauggcaacggggucuggauuggaagaacaaaaagcaucuccucucggaagggcuucgagaugaucugggauccuaauggguggaccggaaccgacaacaauuuuagcauuaaacaagacaucgugggcauuaacgaaugguccggguacucuggcagcuucguucagcaucccgagcuuacaggacuggauuguauccgcccuugcuucuggguggaacucauuagaggccggcccaaggagaauacgaucuggaccuccgggagcucuaucuccuuuuguggagucaacagcgacacagugggcuggucuuggcccgauggggcugagcugccuuucaccauugacaaauga

SEQ ID NO: 206436 - RNA, 1410 nt, Artificial Sequence
  derived and/or modified sequence opt5 from neuraminidase__InfluenzaA__AGJ73350
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacgagcauuccaacggcaccauuaaggauagaagcccuuaucggacgcucaugucuugucccaucggggaagugccuucccccuacaacagccgcuuugaguccguugccuggucugcuagcgccugccacgacggaauuaauuggcugaccaucggcaucuccgggccugauaacggagcuguggccguccugaaauauaauggcauuaucacagacaccauuaagagcuggagaaacaauauccuccggacacaagagucugaaugugcgugcgugaacggguccuguuucaccauuaugacggauggaccgagcgacggccaggccucuuacaagaucuuucgcaucgagaaaggcaagauugugaaaagcgucguuaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaagaccggauccugcggcccggucagcucuaauggggccaacggagugaaaggcuucuccuuuaaguauggcaacgggguuuggaucggaagaacaaagagcauuuccucucggaaaggcuucgagaugaucugggauccuaauggguggaccggaaccgacaacaauuuuagcaucaagcaagacauugugggcaucaacgaaugguccggguacucuggcagcuucguccagcaucccgagcuuacaggacuggauuguauucgcccuugcuucuggguggaacucaucagaggccggcccaaagagaauacgauuuggaccuccgggagcucuaucuccuuuuguggaguuaacagcgacacagugggcuggucuuggcccgauggggcugagcugccuuucaccaucgacaaguga

SEQ ID NO: 206437 - RNA, 1410 nt, Artificial Sequence
  derived and/or modified sequence opt5 from neuraminidase__InfluenzaA__AGJ73352
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuuguuggaaacagcucccugugcccugugagcggcugggcgauuuacucuaaggacaauuccaucagaaucgggagcaaaggagaugucuuugugauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggagguuccuagccccuacaacucccgcuuugaaucuguggcuuggagcgccuccgcuugccacgacggaauuaacuggcugaccaucggcaucagcgggccugauaauggagccgucgcugugcugaaguauaacggcauuaucacagacaccauuaagucuuggagaaauaacauccuccggacacaagaguccgagugugccugcgugaaugggagcuguuucaccauuaugacggauggaccgucugacggccaggcgagcuacaaaaucuuucgcaucgaaaagggcaaaauugucaaguccguugagaugaacgcccccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauagcccucgccccaacgacaaaaccggaucuugcggcccggucuccagcaauggggcuaacggagugaagggcuucuccuuuaaguauggcaaugggguuuggaucggaagaacaaaaucuauuagcucccggaagggcuucgagaugaucugggauccuaacggguggaccggaaccgacaacaauuuuucuaucaaacaagacauugugggcaucaacgaauggagcggguacuccggcagcuucguccagcaucccgagcuuacaggacuggauuguauucgcccuugcuucuggguggaacucaucagaggccggcccaaggagaauacgauuuggaccucuggguccagcaucucuuuuuguggaguuaacuccgacacagugggcuggagcuggcccgauggggccgagcugccuuucaccaucgacaaauga

SEQ ID NO: 206438 - RNA, 1410 nt, Artificial Sequence; identical to SEQ ID NO: 203733
  derived and/or modified sequence opt5 from neuraminidase__InfluenzaA__AGJ73354

SEQ ID NO: 206439 - RNA, 1410 nt, Artificial Sequence
  derived and/or modified sequence opt5 from neuraminidase__InfluenzaA__AGJ73356
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuauuucaauaucagcaacacaaauuuugcugccgggcaguccguggugucugucaaacuugcgggaaacagcucccugugcccugugagcggcugggcuauuuacucuaaggacaauuccaucagaaucgggagcaaaggagauguuuucgugauucgggagccguuuaucucuuguagcccccucgaaugccgcaccuucuuucugacacagggcgcccuucugaacgacaagcauuccaauggcaccauuaaagauagaucuccuuaucggacgcucauguccugucccaucggggaggucccuagccccuacaacucccgcuucgaaucuguggccuggagcgcuuccgccugccacgacggaauuaacuggcugaccaucggcaucagcgggccugauaauggagcuguugccgugcugaaguauaacggcauuaucacagacaccauuaagucuuggagaaauaacauccuccggacacaagaguccgagugugcgugcgucaaugggagcuguuuuaccauuaugacggauggaccgucugacggccaggccagcuacaaaaucuuccgcaucgaaaagggcaaaauugugaaguccguggagaugaacgcucccaauuaucauuacgaagagugcucuuguuacccugauagcuccgagaucacaugcgucugcagagacaacuggcacgggagcaaucggcccuggguuucuuuuaaccagaaucuggaauaucagauuggauacaucuguuccggcauuuucggggauaacccucgccccaaugacaaaaccggaagcugcggcccggugucuuccaacggggccaauggagugaagggcuuuagcuucaaguauggcaacggggucuggaucggaagaacaaaauccauuucuagccggaagggcuuugagaugaucugggauccuaacggguggaccggaaccgacaauaacuucuccaucaaacaagacauugugggcaucaaugaauggucuggguacagcggcuccuucguucagcaucccgagcuuacaggacuggauuguauucgcccuugcuuuuggguggaacucaucagaggccggcccaaggagaacacgauuuggaccagcgggucuuccaucagcuucuguggagucaauucugacacagugggcugguccuggcccgauggggcugagcugccuuuuaccaucgacaaauga

SEQ ID NO: 206440 - RNA, 1410 nt, Artificial Sequence; identical to SEQ ID NO: 203733
  derived and/or modified sequence opt5 from neuraminidase__InfluenzaA__AGJ73358

SEQ ID NO: 206441 - RNA, 1410 nt, Artificial Sequence; identical to SEQ ID NO: 203733
  derived and/or modified sequence opt5 from neuraminidase__InfluenzaA__AGJ73360

SEQ ID NO: 206442 - RNA, 1410 nt, Artificial Sequence
  derived and/or modified sequence opt5 from neuraminidase__InfluenzaA__AGJ73362
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugacgggcaguccguggucucugugaaacuugccggaaacagcucccugugcccuguuagcggcugggcgauuuacucuaaggauaauuccaucagaaucgggagcaaaggagacguguuugucauucgggagccguucaucucuuguagcccccucgaaugccgcaccuuuuuccugacacagggcgcccuucugaacgauaagcauuccaauggcaccauuaaagacagaucuccuuaucggacgcucauguccugucccaucggggaggugccuagccccuacaacucccgcuuugaaucuguugcuuggagcgccuccgcuugccacgauggaauuaacuggcugaccaucggcaucagcgggccugacaauggagccguggcuguccugaaguauaacggcauuaucacagauaccauuaagucuuggagaaauaacauccuccggacacaagaguccgagugugccugcgugaaugggagcuguuucaccauuaugacggacggaccgucugauggccaggcgagcuacaaaaucuuucgcaucgaaaagggcaaaauugugaaguccgucgagaugaacgcccccaauuaucauuacgaagagugcucuuguuacccugacagcuccgagaucacaugcguuugcagagauaacuggcacgggagcaaucggcccugggugucuuucaaccagaaucuggaauaucagauuggauacaucuguuccggcauuuuuggggacaacccucgccccaaugauaaaaccggaagcugcggcccggugucuuccaacggggcuaauggagucaagggcuucagcuuuaaguauggcaacgggguguggaucggaagaacaaaauccauuucuagccggaagggcuucgagaugaucugggacccuaacggguggaccggaaccgacaauaacuuuuccaucaaacaagauauuguuggcaucaaugaauggucuggguacagcggcuccuucgugcagcaucccgagcuuacaggacuggacuguauucgcccuugcuucugggucgaacucaucagaggccggcccaaggagaacacgauuuggaccagcgggucuuccaucagcuuuuguggaguuaauucugauacagugggcugguccuggcccgacggggccgagcugccuuucaccaucgauaaauga

SEQ ID NO: 206443 - RNA, 1410 nt, Artificial Sequence; identical to SEQ ID NO: 204856
  derived and/or modified sequence opt5 from neuraminidase__InfluenzaA__AGJ73364

SEQ ID NO: 206444 - RNA, 1410 nt, Artificial Sequence; identical to SEQ ID NO: 203733
  derived and/or modified sequence opt5 from neuraminidase__InfluenzaA__AGJ73366

SEQ ID NO: 206445 - RNA, 1410 nt, Artificial Sequence; identical to SEQ ID NO: 203281
  derived and/or modified sequence opt5 from neuraminidase__InfluenzaA__AGJ73370

SEQ ID NO: 206446 - RNA, 1410 nt, Artificial Sequence
  derived and/or modified sequence opt5 from neuraminidase__InfluenzaA__AGJ73372
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucauaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaagggcuucgagaugaucugggauccuaauggguggaccggaaccgacaacaauuuuagcaucaaacaggacauuguuggcaucaacgaaugguccggguacucuggcagcuucgugcaacaccccgagcuuacaggacuggauuguauucgcccuugcuucugggucgaacucaucagaggccggcccaaggagaauacgauuuggaccuccgggagcucuaucuccuuuuguggagugaacagcgacacaguuggcuggucuuggcccgauggggcugagcugccuuucaccaucgacaaauga

SEQ ID NO: 206447 - RNA, 1410 nt, Artificial Sequence; identical to SEQ ID NO: 203281
  derived and/or modified sequence opt5 from neuraminidase__InfluenzaA__AGJ73374

SEQ ID NO: 206448 - RNA, 1410 nt, Artificial Sequence
  derived and/or modified sequence opt5 from neuraminidase__InfluenzaA__AGJ73376
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauucugcgcaucgaaaagggcaaaaucgucaagucuguugagaugaaugcucccaacuaucauuacgaagagugcagcuguuacccugauuccagcgagauuacaugcgugugcagagacaauuggcacgggucuaaccggcccuggguguccuuuaaucagaaccuugaauaucagaucggauacauuuguagcggcaucuucggggauaauccucgccccaacgacaaaaccggaucuugcggcccggucuccagcaauggggccaacggagugaagggcuuuuccuucaaguauggcaaugggguuuggauuggaagaacaaaaucuaucagcucccggaagggcuuugagaugauuugggauccuaacggguggaccggaaccgacaacaauuucucuacaaaacaagacaucgugggcaucaacgaauggagcggguacuccggcagcuuuguccagcaucccgagcugacgggacucgauuguauucgcccuugcuucuggguggaacugaucagaggccggcccaaggagaauaccauuuggacaucuggguccagcaucucuuucuguggaguuaacuccgacaccgugggcuggagcuggcccgauggggcugagcuuccuuuuacaauugacaaauga

SEQ ID NO: 206449 - RNA, 1410 nt, Artificial Sequence
  derived and/or modified sequence opt5 from neuraminidase__InfluenzaA__AGJ73379
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagaugaaugcucccaacuaucauuacgaagagugcagcuguuacccugauuccagcgagauuacaugcgugugcagagacaauuggcacgggucuaaccggcccuggguguccuucaaucagaaccuggaauaucagaucggauacauuuguagcggcaucuuuggggauaauccucgccccaacgacaaaaccggaucuugcggcccggucuccagcaauggggccaacggagugaagggcuucuccuuuaaguauggcaaugggguuuggauuggaagaacaaaaucuaucagcucccggaagggcuucgagaugauuugggauccuaacggguggaccggaaccgacaacaauuuuucuaucaaacaagacaucauuggcaucaacgaauggagcggguacuccggcagcuucgugcagcaucccgagcuuacaggacuggauuguauucgcccuugcuucugggucgaacucaucagaggccggcccaaggagaauacgauuuggaccucuggguccagcaucucuuuuuguggagugaacuccgacacaguuggcuggagcuggcccgauggggcugagcugccuuucaccaucgacaaauga

SEQ ID NO: 206450 - RNA, 1410 nt, Artificial Sequence
  derived and/or modified sequence opt5 from neuraminidase__InfluenzaA__AGJ73381
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacgagcauuccaauggcaccaucaaggauagaucuccuuaucggacgcucauguccugucccauuggggaaguuccuagccccuacaacucccgcuuugagucuguggccuggagcgcuuccgccugccacgacggaaucaacuggcugaccauuggcaucagcgggccugauucuggagcugucgccgugcugaaauauaauggcaucauuacagacaccaucaaguccuggagaaacaauauucuccggacacaagagagcgaaugugcgugcgugaacgggucuuguuucaccaucaugacggauggaccgagcgacggccaggccuccuacaagauuuuucgcaucgagaaaggcaagaucgucaaaucuguugaaaugaaugcucccaacuaucauuacgaggagugcagcuguuacccugauuccagcgaaauuacaugcgugugcagagacaauuggcacgggucuaaccggcccuggguguccuucaaucagaaccuggaguaucagaucggauacauuuguagcggcaucuuuggggauaauccucgccccaacgacaagaccggaucuugcggcccggucuccagcaauggggccaacggagugaaaggcuucuccuuuaaguauggcaaugggguuuggauuggaagaacaaagucuaucagcucccggaaaggcuucgaaaugauuugggauccuaacggguggaccggaaccgacaacaauuuuucuaucaagcaagacaucgugggcauuaacgaguggagcggguacuccggcagcuucguccagcaucccgaacuuacaggacuggauuguauccgcccuugcuucuggguggagcucauuagaggccggcccaaagagaauacgaucuggaccucuggguccagcauuucuuuuuguggaguuaacuccgacacagugggcuggagcuggcccgauggggcugaacugccuuucaccaucgacaaguga

SEQ ID NO: 206451 - RNA, 1410 nt, Artificial Sequence
  derived and/or modified sequence opt5 from neuraminidase__InfluenzaA__AGK62992
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggugaaaagcuguaucaaccggugcuuuuauguugaacugauuagagggcgcaaggaggaaaccgaggugcuguggacauccaauucuaucgucguguucuguggaaccagcggcacauacgggacgggauccuggccugacggcgcugauauuaaccucaugcccaucuga

SEQ ID NO: 206452 - RNA, 1410 nt, Artificial Sequence
  derived and/or modified sequence opt5 from neuraminidase__InfluenzaA__AGK62996
augaaccccaaucagaagaucauuaccaucggcagcgugucccugauuaucucuacaauuugcuucuuuaugcaaaucgccauccucauuacgaccgucacacugcacuucaaacaguacgaguuuaacagcccuccgaauaaccagguuaugcuuugugaacccaccaucauugagagaaauaucacagaaauuguguaucugaccaacacaaccaucgagaaggaaauuugcccuaaacccgcugaguaccggaauugguccaagccucagugugacaucacgggguucgcccccuuuucuaaagauaacagcauccgccucuccgcgggaggcgacauuugggugaccagagagccuuaugucucuugcgauccggacaaguguuaccaauucgcucuggggcagggaacaacccuuaauaacgugcauagcaauaacacaguucgggaucgcacccccuauagaacgcugcucaugaaugaacugggcgugccuuuucaccuggggacaaagcaggucugcaucgccugguccucuagcuccugucaugacggaaaagccuggcuccacgugugcauuaccggcgaugacaagaacgcuacagccagcuucaucuacaauggccggcugguugauucuguggucuccuggagcaaagagauucuucgcacccaggaaucugagugugugugcaucaacgggaccuguacaguggucaugacggacggauccgcuagcggcaaggccgauaccaaaauccuguuuauugaggaagggaagaucguucauacauccacccucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacacaccgcggaagaaugauagcuccucuagcucccauugccuugacccuaacaaugaggaaggcgggcacggagugaaaggcugggccuucgaugacgggaacgauguuuggaugggacgcaccaucaaugagacgagcagacugggcuaugagacauuuaaggugauugaaggguggucuaaccccaaauccaagcuccagaucaaucggcaggucauuguggaccgcggagauagaagcggcuacucuggcaucuucuccgucgagagcaaauccuguauuaaccggugcuuuuauguggaacugaucagagggcgcaaggaggaaaccgagguucuguggaccucuaauagcauuguggucuucuguggaacauccggcaccuacgggacaggaucuuggccugacggcgcugauaucaaccucaugcccaucuga

SEQ ID NO: 206453 - RNA, 1410 nt, Artificial Sequence
  derived and/or modified sequence opt5 from neuraminidase__InfluenzaA__AGK62998
augaaccccaaucagaagaucauuaccaucggcagcgugucccugacaauugccacgaucugcuucuuuaugcaaauugcuauccucaucaccacagucacccugcacuucaaacagugugaguuuaacucuccuccgaauaaccagguuaugcuuugcgaacccacaauuaucgagagaaauauuaccgaaaucguguaccugacaaacaccacgauugagaaggaaaucuguccuaaacucgccgaguaucggaauuggagcaagccccagugcgacauuaccggguucgcgccuuuuuccaaagauaacucuauccgccugagcgcuggaggcgacaucugggugacaagagagcccuacgucuccugugauccugacaagugcuaucaauucgcccuugggcagggaaccacacugaauaacgugcauucuaauaacaccguucgggaucgcacgccguacagaacacuccugaugaaugaacugggcgugcccuuucaccucgggaccaagcaggucuguauggccuggagcuccagcucuugccaugacggaaaggcuuggcugcacguguguauuacaggcgaugacaagaacgccaccgcuuccuucaucuauaauggccggcuuguugauagcguggucucuugguccaaagagauucugcgcacccaggaaagcgagugcguguguaucaacgggacaugcacgguggucaugaccgacggaucugccuccggcaaggcggauacaaaaauucucuuuaucgaggaagggaagaucguucauaccagcacacuguccggaucugcccaacacguggaggaaugcagcuguuacccuagauaucccggcgugcggugcgucugucgcgacaacuggaagggguccaauagaccuauuguggauaucaacauuaaagaccacagcaucguuucuuccuacgugugcagcggacuucugggcgacacgccccggaagaaugauucuagcuccucuagccauugucucgacccgaacaaugaggaaggcgggcacggagucaaaggcugggcuuucgaugacgggaacgauguguggaugggacgcaccauuuccgagaaaagcagacugggcuacgagacauuuaaaguuaucgaaggguggucuaauccuaaguccaaacugcagaucaaccgccaggugauugucgaccggggagauagaagcggcuauucuggcaucuucuccguggagagcaaguccugcauuaaucgguguuuuuacgucgaacucaucagagggcgcaaggaggaaaccgaggugcuguggaccucuaacagcauuguuguguucugcggaacauccggcaccuaugggacaggaucuuggcccgacggcgccgauaucaaucuuaugccuauuuga

SEQ ID NO: 206454 - RNA, 1410 nt, Artificial Sequence
  derived and/or modified sequence opt5 from neuraminidase__InfluenzaA__AGK63000
augaaccccaaucagaagaucauuaccaucggcagcgugucccugacaauugccacgaucugcuucuuuaugcaaauugcuauccucaucaccacagucacccugcacuucaaacagugugacuuuaacucuccuccgaauaaccagguuaugcuuugcgagcccacaauuaucgaaagaaauauuaccgagaucguguaccugacaaacaccacgauugaaaaggagaucuguccuaaacucgccgaauaucggaauuggagcaagccccagugcgauauuaccggguucgcgccuuuuuccaaagacaacucuauccgccugagcgcuggaggcgauaucugggugacaagagagcccuacgucuccugugacccugauaagugcuaucaauucgcccuugggcagggaaccacacugaauaacgugcauucuaauaacaccguucgggaccgcacgccguacagaacacuccugaugaaugagcugggcgugcccuuucaccucgggaccaagcaggucuguauggccuggagcuccagcucuugccaugauggaaaggcuuggcugcacguguguauuacaggcgacgauaaaaacgccaccgcuuccuucaucuauaauggcaaacuuguugacagcguggucucuugguccaaggaaauucugcggacccaggagagcgaaugcguguguaucaacgggacaugcacgguggucaugaccgauggaucugccuccggcaaagcggacacaaagauucucuuuaucgaggaggggaagaucguucauaccagcacacuguccggaucugcccaacacguggaagagugcagcuguuacccucgcuaucccggcgugagaugcgucugucgggauaacuggaaaggguccaaucgcccuauuguggacaucaacauuaaggaccacagcaucguuucuuccuacgugugcagcggacuugucggcgauacccccagaaagaaugacucuagcuccucuagccauugucuggauccgaacaaugaagagggcgggcacggagugaaaggcugggcuuucgacgaugggaacgacguuuggaugggacggacgauuaaugaaacaucccgccucggcuacgagaccuuuaaagugaucgagggguggagcaacccuaagucuaaacugcagaucaauagacaggucauuguggaucggggagaccgcuccggcuauagcggcaucuucucugucgaagggaaguccugcauuaacagauguuuuuacguggagcugauccggggaagaaaggaagagaccgaaguucucuggacaagcaauuccauuguggucuucugcggcaccucugggacauauggaacgggcagcuggcccgauggggccgacaucaaccugaugccuauuuga

SEQ ID NO: 206455 - RNA, 1410 nt, Artificial Sequence
  derived and/or modified sequence opt5 from neuraminidase__InfluenzaA__AGK63002
augaaccccaaucagaagaucauuaccaucggcagcgugucccugacaauuucuacgaucugcuucuuuaugcaaauugccauccucaugaccacagucacccugcacuucaaacagugugaguuuaacagcccuccgaauaaccagguuaugcuuugcgaacccacaaucauugagagaaauaucaccgaaauuguguaccugacaaacaccacgaucgagaaggaaauuuguccuaaacucgcugaguaucggaauugguccaagccccagugcgacaucaccggguucgccccuuuuucuaaagauaacagcauucgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugaacugggcgugcccuuucaccucgggaccaagcaggucuguauggccugguccucuagcuccugccaugacggaaaagccuggcugcacguguguaucacaggcaacgauaagaaugcuaccgccagcuucauuuauaacggccggcuuguugacucuguggucuccuggagcaaagagauccugcgcacccaggaaucugagugcguguguauuaacgggacaugcacgguggucaugaccgauggauccgcuagcggcaaggccgacacaaaaauccucuuuauugaggaagggaagaucguucauaccuccacacugucuggaagcgcgcaacacguggaggaaugcuccuguuacccuagauaucccggcgugcggugcgucugucgcgauaauuggaaggggagcaacagaccuaucguggacauuaauaucaaagaucacucuauuguuuccagcuacgugugcucuggacuugucggcgacacgccccggaagaacgacagcuccucuagcucccauugucuggauccgaauaacgaggaaggcgggcacggagugaaaggcugggccuucgacgaugggaaugacguuuggaugggacgcaccaucacagagaccagcagacucggcuacgagaccuuuaaggugauugaaggguggucuaacccuaaauccaagcugcagaucaaucggcaggucaucguggaucgcggagacagaagcggcuauucuggcauuuucuccgucgaggggaaaagcugcaucaaccgguguuuuuacguggaacugauuagaggacgcaaggaggaaacagagguucucuggaccuccaauucuaucguggucuucugcggcacaagcgggacguauggaaccggcuccuggcccgauggggcugacauuaaccugaugccuaucuga

SEQ ID NO: 206456 - RNA, 1410 nt, Artificial Sequence
  derived and/or modified sequence opt5 from neuraminidase__InfluenzaA__AGK63004
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcucccaacacguggaggaaugcagcugcuaucccagauacccuggcgugcggugugucugccgcgacaacuggaaggggucuaauagacccaucguggauauuaacaucaaagaccacuccauuguuagcucuuacguguguagcggacuggucggcgacaccccgcggaagaaugauuccucuagcuccagccauugccuugacccuaacaaugaggaaggcgggcacggagugaaaggcugggcguucgaugacgggaacgauguuuggaugggacgcacgaucaaugagacaucuagacugggcuaugagaccuuuaaggugaucgaagggugguccaaccccaaaagcaagcuccagauuaaucggcaggucaucguggaccgcggagauagaucuggcuacuccggcauuuucagcgucgaggggaaauccuguaucaaccggugcuuuuauguggaacugauuagaggacgcaaggaggaaaccgagguucuguggacaucuaauagcaucguggucuucuguggcaccuccgggacauacggaacgggcucuuggccugacggggccgauauuaaccucaugcccaucuga

SEQ ID NO: 206457 - RNA, 1410 nt, Artificial Sequence
  derived and/or modified sequence opt5 from neuraminidase__InfluenzaA__AGK63006
augaaccccaaucagaagaucauuaccaucggcagcgugucccugacaauugccacgaucugcuucuuuaugcaaauugcuauccucaucaccacagucacccugcacuucaaacaguacgaguuuaacucuccuccgaauaaccagguuaugcuuugugaacccacaauuaucgagagaaauauuaccgaaaucguguaucugacaaacaccacgauugagaaggaaaucugcccuaaacccgccgaguaccggaauuggagcaagccucagugugacauuaccggguucgcgcccuuuuccaaagauaacucuauccgccucagcgcuggaggcgacaucugggugacaagagagccuuaugucuccugcgauccggacaaguguuaccaauucgcccuggggcagggaaccacacuuaauaacgugcauucuaauaacaccguucgggaucgcacgcccuauagaacacugcucaugaaugaacugggcgugccuuuucaccuggggaccaagcaggucugcauugccuggagcuccagcucuugucaugacggaaaggcuuggcuccacgugugcaucacaggcgaugacaaaaacgccaccgcuuccuucauuuacaauggccggcugguugauagcguggucucuugguccaaagagauccuucgcacccaggaaagcgagugugugugcauuaacgggacauguacgguggucaugaccgacggaucugccuccgcgaaggccgauacaaaaauccuguuuaucgaggaaggcaagauuguucauaccagcacacucuccgggucugcucaacacguggaggaaugcagcugcuaucccagauacuccggagugcggugugucugccgcgacaacuggaagggcagcaauagaccuaucguggauauuaacaucaaagaccacucuauuguuuccagcuacguguguucugggcuggucggagacacgccccggaagaaugauagcuccucuagcucccauugccuugacccgaacaaugaggaaggcggccacggggugaaaggaugggccuucgaugacggcaacgauguuuggauggggcgcaccaucaaugagacaagcagacugggauaugagaccuuuaaggugaucgaaggcuggucuaacccuaaaucccagcuccagauuaaucggcaggucaucguggaccgcggggauagaagcggauacucuggcauuuucuccgucgagagcaaguccuguaucaaccggugcuuuuauguggaacugauuagaggccgcaaagaggaaaccgagguucuguggacaucuaauagcaucguggucuucugugggaccuccggaacauacggcacggggucuuggcccgacggagcugauauuaaccucaugccuaucuga

SEQ ID NO: 206458 - RNA, 1410 nt, Artificial Sequence
  derived and/or modified sequence opt5 from neuraminidase__InfluenzaA__AGK63008
augaaccccaaucagaagaucauuaccaucggcagcgugucccugacaauugccacgaucugcuucuuuaugcaaauugcuauccucaucaccacagucacccugcacuucaaacagugugaguuuaacucuccuccgaauaaccagguuaugcuuugcgaacccacaauuaucgagagaaauauuaccgaaaucguguaccugacaaacaccacgauugagaaggaaaucuguccuaaacucgccgaguaucggaauuggagcaagccccagugcgacauuaccggguucgcgccuuuuuccaaagauaacucuauccgccugagcgcuggaggcgacaucugggugacaagagagcccuacgucuccugugauccugacaagugcuaucaauucgcccuugggcagggaaccacacugaauaacgugcauucuaauaacaccguucgggaucgcacgccguacagaacacuccugaugaaugaacugggcgugcccuuucaccucgggaccaagcaggucuguauggccuggagcuccagcucuugccaugacggaaaggcuuggcugcacguguguauuacaggcgaugacaaaaacgccaccgcuuccuucaucuauaauggcaaacuuguugauagcguggucucuugguccaaggagauucugcggacccaggaaagcgagugcguguguaucaacgggacaugcacgguggucaugaccgacggaucugccuccggcaaagcggauacaaagauucucuuuaucgaggaagggaagaucguucauaccagcacacuguccggaucugcccaacacguggaggaaugcagcuguuacccucgcuaucccggcgugagaugcgucugucgggacaacuggaaaggguccaaucgcccuauuguggauaucaacauuaaggaccacagcaucguuucuuccuacgugugcagcggacuugucggcgacacccccagaaagaaugauucuagcuccucuagccauugucuggacccgaacaaugaggaaggcgggcacggagugaaaggcugggcuuucgaugacgggaacgauguuuggaugggacggacgauuaaugagacaucccgccucggcuacgagaccuuuaaagugaucgaaggguggagcaacccuaagucuaaacugcagaugaauagacaggucaucguggaccggggagaucgcuccggcuauagcggcauuuucucugucgaggggaaguccugcaucaacagauguuuuuacguggaacugauucggggaagaaaggaggaaaccgagguucucuggacaagcaauuccaucguggucuucugcggcaccucugggacauauggaacgggcagcuggcccgacggggccgauauuaaccugaugccuaucuga

SEQ ID NO: 206459 - RNA, 1410 nt, Artificial Sequence
  derived and/or modified sequence opt5 from neuraminidase__InfluenzaA__AGK63010
augaaccccaaucagaagaucauuaccaucggcagcgugucccugacaauugccacgaucugcuucuuuaugcaaauugcuauccucaucaccacagucacccugcacuucaaacagugugaguuuaacucuccuccgaauaaccagguuaugcuuugcgaacccacaauuaucgagagaaauauuaccgaaaucguguaccugacaaacaccacgauugagaaggaaaucuguccuaaacucgccgaguaucggaauuggagcaagccccagugcgacauuaccggguucgcgccuuuuuccaaagauaacucuauccgccugagcgcuggaggcgacaucugggugacaagagagcccuacgucuccugugauccugacaagugcuaucaauucgcccuugggcagggaaccacacugaauaacgugcauucuaauaacaccguucgggaucgcacgccguacagaacacuccugaugaaugaacugggcgugcccuuucaccucgggaccaagcaggucuguauggccuggagcuccagcucuugccaugacggaaaggcuuggcugcacguguguauuacaggcgaugacaaaaacgccaccgcuuccuucaucuauaauggcaaacuuguugauagcguggucucuugguccaaggagauucugcggacccaggaaagcgagugcguguguaucaacgggacaugcacgguggucaugaccgacggaucugccuccggcaaagcggauacaaagauucucuuuaucgaggaagggaagaucguucauaccagcacacuguccggaucugcccaacacguggaggaaugcagcuguuacccucgcuaucccggcgugagaugcgucugucgggacaacuggaaaggguccaaucgcccuauuguggauaucaacauuaaggaccacagcaucguuucuuccuacgugugcagcggacuugucggcgacacccccagaaagaaugauucuagcuccucuagccauugucuggacccgaacaaugaggaaggcgggcacggagugaaaggcugggcuuucgaugacgggaacgauguuuggaugggacggacgauuaaugagacaucccgccucggcuacgagaccuuuaaagugaucgaaggguggagcgacccuaagucuaaacugcagaucaacagacaggucauuguggaucggggagaccgcuccggcuauagcggcaucuucucugucgaggggaaguccugcauuaauagauguuuuuacguggaacugauccggggaagaaaggaggaaaccgagguucucuggacaagcaacuccauuguggucuucugcggcaccucugggacauauggaacgggcagcuggcccgauggggccgacaucaaucugaugccuauuuga

SEQ ID NO: 206460 - RNA, 1410 nt, Artificial Sequence
  derived and/or modified sequence opt5 from neuraminidase__InfluenzaA__AGK63012
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggauacagaagcggcuauucuggcauuuucuccgucgaggggaaaagcuguaucaaccggugcuuuuacguggaucugauuagaggacgcaaggaagagaccgaaguucuguggacauccaauucuaucguggucuucuguggcaccagcgggacauauggaacgggcuccuggccugacggggcugauauuaaccucaugcccaucuga

SEQ ID NO: 206461 - RNA, 1410 nt, Artificial Sequence
  derived and/or modified sequence opt5 from neuraminidase__InfluenzaA__AGK63014
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuuccccuggggaccaagcaggucugcauugccugguccucuagcuccugucacgacggaaaagccuggcuccaugugugcaucacaggcgaugacaagaacgcuaccgccagcuucauuuacaauggccggcugguugauucuguggucuccuggagcaaagagauccaccgcacccaggaaucugagugugugugcauuaacgggacauguacgguggucaugaccgacggauccgcuagcggcaaggccgauacaaaaauccuuuuuaucgaggaagggaagauuguucauaccuccacacugucuggaagcgcgcaacacguggaggaaugcuccugcuauccuagauaccccggcgugcggugugucugccgcgacaacuggaaggggagcaauagaccgaucguggauauuaacaucaaagaccacucuauuguuuccagcuacguguguucuggacucgucggcgacaccccucggaagaaugauagcuccucuagcucccauugccuggaccccaacaaugaggaaggcgggcacggagugaaaggcugggccuucgaugacgggaacgauguuuggaugggacgcacgaucagcgagaagucuagacuuggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacucauuagaggacgcaaggaggaaaccgagguucuguggaccucuaauagcaucguggucuucuguggcacauccgggaccuacggaacaggcucuuggcccgauggggcugacauuaaccugaugcccaucuga

SEQ ID NO: 206462 - RNA, 1410 nt, Artificial Sequence
  derived and/or modified sequence opt5 from neuraminidase__InfluenzaA__AGK63018
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugaacugggcgugcccuuucaccucgggaccaagcaggucuguauggccugguccucuagcuccugccaugacggaaaagccuggcugcacguguguauuacaggcgaugacaagaacgcuaccgccagcuucaucuauaauggcaaacuuguugauucuguggucuccuggagcaaggagauucugcggacccaggaaucugagugcguguguaucaacgggacaugcacgguggucaugaccgacggauccgcuagcggcaaagccgauacaaagauucucuuuaucgaggaagggaagaucguucauaccuccacacugucuggaagcgcgcaacacguggaggaaugcuccuguuacccucgcuaucccggcgugagaugcgucugucgggacaacuggaaagggagcaaucgcccuauuguggauaucaacauuaaggaccacucuaucguuuccagcuacgugugcucuggacuugucggcgacacccccagaaagaaugauagcuccucuagcucccauugucuggacccgaacaaugaggaaggcgggcacggagugaagggcugggccuucgaugacgggaacgauguuuggaugggacggacgauuaaugagacaagccgccucggcuacgagaccuuuaaagugaucgaaggguggucuaacccuaaguccaaacugcagaucaauagacaggucauuguggaccggggagaucgcagcggcuauucuggcaucuucuccgucgaggggaaaagcugcauuaacagauguuuuuacguggaacugauccggggaagaaaggaggaaaccgagguucucuggacauccaauucuauuguggucuucugcggcaccagcgggacauauggaacgggcuccuggcccgacggggcugauaucaaccugaugccuauuuga

SEQ ID NO: 206463 - RNA, 1410 nt, Artificial Sequence
  derived and/or modified sequence opt5 from neuraminidase__InfluenzaA__AGK63020
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggacauccaauucuaucguggucuucuguggcaccagcgggacauacggaacgggcuccuggccugacggggcugauauuaaccucaugcccaucuga

SEQ ID NO: 206464 - RNA, 1410 nt, Artificial Sequence
  derived and/or modified sequence opt5 from neuraminidase__InfluenzaA__AGK63022
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugaacugggcgugcccuuucaccucgggaccaagcaggucuguauggccugguccucuagcuccugccaugacggaaaagccuggcugcacguguguauuacaggcgaugacaagaacgcuaccgccagcuucaucuauaauggcaaacuuguugauucuguggucuccuggagcaaggagauucugcggacccaggaaucugagugcguguguaucaacgggacaugcacgguggucaugaccgacggauccgcuagcggcaaagccgauacaaagauucucuuuaucgaggaagggaagaucguucauaccuccacacugucuggaagcgcgcaacacguggaggaaugcuccuguuacccucgcuaucccggcgugagaugcgucugucgggacaacuggaaagggagcaaucgcccuauuguggauaucaacauuaaggaccacucuaucguuuccagcuacgugugcucuggacuugucggcgacacccccagaaagaaugauagcuccucuagcucccauugucuggacccgaacaaugaggaaggcgggcacggagugaagggcugggccuucgaugacgggaacgauguuuggaugggacggacgauuaaugagacaagccgccucggcuacgagaccuuuaaagugaucgaaggguggucuaacccuaaguccaaacugcagaucaauagacaggucauuguggaccggggagaucgcagcggcuauucuggcaucuucuccgucgaggggaaaagcugcauuaacagauguuuuuacguggaccugauccggggaagaaaggaagagaccgaaguucucuggacauccaauucuauuguggucuucugcggcaccagcgggacauauggaacgggcuccuggcccgauggggcugacaucaaccugaugccuauuuga

SEQ ID NO: 206465 - RNA, 1410 nt, Artificial Sequence; identical to SEQ ID NO: 206463
  derived and/or modified sequence opt5 from neuraminidase__InfluenzaA__AGK63024

SEQ ID NO: 206466 - RNA, 1410 nt, Artificial Sequence; identical to SEQ ID NO: 206463
  derived and/or modified sequence opt5 from neuraminidase__InfluenzaA__AGK63026

SEQ ID NO: 206467 - RNA, 1410 nt, Artificial Sequence
  derived and/or modified sequence opt5 from neuraminidase__InfluenzaA__AGK63028
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaagaccgaaauuguguaucugacaaacaccacgaucgagaaagaaauuugcccuaagcccgcugaguaccggaauugguccaaaccucagugugacaucaccggguucgcccccuuuucuaaggauaacagcauucgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaaacaggucugcaucgccugguccucuagcuccugucaugacggaaaggccuggcuccacgugugcauuacaggcgaugacaaaaacgcuaccgccagcuucaucuacaauggccggcugguugauucuguggucuccuggagcaaggagauucuucgcacccaggaaucugagugugugugcaucaacgggacauguacgguggucaugaccgacggauccgcuagcggcaaagccgauacaaagauucuguuuaucgaggaagggaagguugugcauaccuccacacucucuggaagcgcgcaacacguggaggaaugcuccugcuaucccagauacccuggcguccggugugugugccgcgacaacuggaaagggagcaauagacccaucguugauauuaacaucaaggaccacucuauuguguccagcuacgucuguucuggacuggugggcgacaccccgcggaaaaaugauagcuccucuagcucccauugccuugacccuaacaaugaggaaggcgggcacggaguuaagggcugggccuucgaugacgggaacgauguguggaugggacgcacgaucaaugagacaagcagacugggcuaugagaccuuuaaagucauugaaggguggucuaaccccaaguccaaacuccagaucaaucgccaggugaucgucgaccggggagauagaagcggcuacucuggcauuuucuccguggaggcuaagagcuguaucauucggugcuuuuauguugaacugaucagagggcgcaaggaggaaaccgaggugcuguggacauccaacucuauugucguguucuguggaaccagcggcacauacgggacgggauccuggccugacggcgccgauaucaaucucaugcccauuuga

SEQ ID NO: 206468 - RNA, 1410 nt, Artificial Sequence; identical to SEQ ID NO: 206462
  derived and/or modified sequence opt5 from neuraminidase__InfluenzaA__AGK63030

SEQ ID NO: 206469 - RNA, 1410 nt, Artificial Sequence
  derived and/or modified sequence opt5 from neuraminidase__InfluenzaA__AGK63032
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauggccugguccucuagcuccugucaugacggaaaagccuggcugcacgugugcauuacaggcgaugacaagaacgcuaccgccagcuucaucuacaauggcaaacuuguugauucuguggucuccuggagcaaggagauucugcggacccaggaaucugagugugugugcaucaacgggacauguacgguggucaugaccgacggauccgcuagcggcaaagccgauacaaagauucucuuuaucgaggaagggaagaucguucauaccuccacacugucuggaagcgcgcaacacguggaggaaugcuccugcuauccucgcuaccccggcgugagaugugucugccgggacaacuggaaagggagcaaucgcccuauuguggauaucaacauuaaggaccacucuaucguuuccagcuacguguguucuggacuugucggcgacacccccagaaagaaugauagcuccucuagcucccauugccuggacccgaacaaugaggaaggcgggcacggagugaagggcugggccuucgaugacgggaacgauguuuggaugggacggacgauuacagagaccagccgccucggcuaugagaccuuuaaagugaucgaaggguggucuaauccuaaguccaaacugcagaucaacagacaggucauuguggaccggggaaaucgcagcggcuacucuggcaucuucuccgucgaggggaaaagcuguauuaacagaugcuuuuauguggaacugauccggggaagaaaggaggaaacagagguucucuggaccuccaauucuauuguggucuucuguggcacaagcgggacguacggaaccggcuccuggcccgauggggcugacaucaaccugaugccuauuuga

SEQ ID NO: 206470 - RNA, 1410 nt, Artificial Sequence
  derived and/or modified sequence opt5 from neuraminidase__InfluenzaA__AGK63034
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugaacugggcgugcccuuucaccucgggaccaagcaggucuguauggccugguccucuagcuccugccaugacggaaaagccuggcugcacguguguauuacaggcgaugacaagaacgcuaccgccagcuucaucuauaauggcaaacuuguugauucuguggucuccuggagcaaggagauucugcggacccaggaaucugagugcguguguaucaacgggacaugcacgguggucaugaccgacggauccgcuagcggcaaagccgauacaaagauucucuuuaucgaggaagggaagaucguucauaccuccacacugucuggaagcgcgcaacacguggaggaaugcuccuguuacccucgcuaucccggcgugagaugcgucugucgggacaacuggaaagggagcaaucgcccuauuguggauaucaacauuaagguucacucuaucguguccagcuacgucugcucuggacuugugggcgacacccccagaaagaaugacagcuccucuagcucccauugucuggauccgaacaaugaggaaggcgggcacggaguuaagggcugggccuucgacgaugggaacgacguguggaugggacggacgauuaaugagacaagccgccucggcuacgagaccuuuaaagucaucgaaggguggucuaacccuaaguccaaacugcagaucaauagacaggugauugucgaucggggagaccgcagcggcuauucuggcaucuucuccguggaggggaaaagcugcauuaacagauguuuuuacguugaacugauccggggaagaaagaaagagaccgaagugcucuggacauccaauucuauugucguguucugcggcaccagcgggacauauggaacgggcuccuggcccgauggggcugacaucaaccugaugccuauuuga

SEQ ID NO: 206471 - RNA, 1410 nt, Artificial Sequence
  derived and/or modified sequence opt5 from neuraminidase__InfluenzaA__AGK63036
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccagcagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagauuuggcuaugagaccaucaaggugauugaaggguggucuaaccccaaauccaaucugcagaucaaccggcaggucauuguggaccgcggaaauagaagcggcuacucuggcaucuucuccgucgaggggaagucuuguauuaaccggugcuuuuauguggaacucaucagaggacgcaaagaggaaaccgagguucuguggacauccaauucuauuguggucuucuguggcaccagcgggacauacggaacgggcuccuggccugauggggcugacaucaaccugaugcccaucuga

SEQ ID NO: 206472 - RNA, 1410 nt, Artificial Sequence
  derived and/or modified sequence opt5 from neuraminidase__InfluenzaA__AGK63038
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauggccugguccucuagcuccugucaugacggaaaagccuggcugcacgugugcauuacaggcgaugacaagaacgcuaccgccagcuucaucuacaauggcaaacuuguugauucuguggucuccuggagcaaggagauucugcggacccaggaaucugagugugugugcaucaacgggacauguacgguggucaugaccgacggauccgcuagcggcaaagccgauacaaagauucucuuuaucgaggaagggaagaucguucauaccuccacacugucuggaagcgcgcaacacguggaggaaugcuccugcuauccucgcuaccccggcgugagaugugucugccgggacaacuggaaagggagcaaucgcccuauuguggauaucaacauuaaggaccacucuaucguuuccagcuacguguguucuggacuugucggcgacacccccagaaagaaugauagcuccucuagcucccauugccuggacccgaacaaugaggaaggcgaucacggggugaaaggaugggccuucgacgauggcaacgacguuuggauggggcggacgauuaaugagacaagccgccucggauaugagaccuuuaaagugaucgaaggcuggucuaacccuaaguccaaacugcagaucaauagacaggucauuguggaucgggggaaccgcagcggauacucuggcaucuucuccgucgagagcaaguccuguauuaauagaugcuuuuauguggaacugauccggggcagaaaggaggaaaccgagguucucuggacaucuaacagcauuguggucuucugugggaccuccggaacauacggcacggggucuuggcccgacggagcugauaucaaucugaugccuauuuga

SEQ ID NO: 206473 - RNA, 1410 nt, Artificial Sequence
  derived and/or modified sequence opt5 from neuraminidase__InfluenzaA__AGK63040
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcaacauuaccggguucgccccuuuuucuaaagacaauagcauccgccuguccgcgggaggcgauaucugggugacaagagagcccuacgucucuugugacccugauaagugcuaucaauucgcucuugggcagggaaccacacugaacaaugugcauagcaacaauaccguucgggaccgcacgccguacagaacacuccugaugaacgaacugggcgugcccuuucaccucgggaccaagcaggucuguauggccugguccucuagcuccugccaugauggaaaagccuggcugcacguguguauuacaggcgacgauaagaaugcuaccgccagcuucaucuauaacggcaaacuuguugacucuguggucuccuggagcaaggagauucugcggacccaggaaucugagugcguguguaucaacgggacaugcacgguggucaugaccgauggauccgcuagcggcaaagccgacacaaagauucucuuuaucgaggaagggaagaucguucauaccuccacacugucuggaagcgcgcaacacguggaggaaugcuccuguuacccucgcuaucccggcgugagaugcgucugucgggauaauuggaaagggagcaaccgcccuauuguggacaucaauauuaaggaucacucuaucguuuccagcuacgugugcucuggacuugucggcgacacccccagaaagaacgacagcuccucuagcucccauugucuggauccgaauaacgaggaaggcgggcacggagugaagggcugggccuucgacgaugggaaugacguuuggaugggacggacgauuaacgagacaagccgccucggcuacgagaccuuuaaagugaucgaaggguggucuaauccuaaguccaaacugcagaucaacagacaggucauuguggaucggggagaccgcagcggcuauucuggcaucuucuccgucgaggggaaaagcugcauuaauagauguuuuuacguggaacugauccggggaagaaaggaggaaaccgagguucucuggacauccaacucuauuguggucuucugcggcaccagcgggacauauggaacgggcuccuggcccgauggggcugacaucaaucugaugccuauuuga

SEQ ID NO: 206474 - RNA, 1410 nt, Artificial Sequence
  derived and/or modified sequence opt5 from neuraminidase__InfluenzaA__AGK63042
augaaccccaaucagaagaucauuaccaucggcagcgugucccugacaauuucuacgaucugcuucuuuaugcaaauugccauccucaucaccacagucacccugcacuucaaacagugugaguuuaacccuccgcccaauaaccagguuaugcuuugcgaaccuacaauuaucgagagaaauauuaccgaaaucguguaccugacaaacaccacgauugagaaggaaaucugucccaaacucgcugaguaucggaauuggagcaagccucagugcgacauuaccggguucgcccccuuuuccaaagauaacucuauccgccugagcgcgggaggcgacaucugggugacaagagagccuuacgucuccugugauccggacaagugcuaucaauucgcucuugggcagggaaccacacugaauaacgugcauucuaauaacaccguucgggaucgcacgcccuacagaacacuccugaugaaugaacugggcgugccuuuucaccucgggaccaagcaggucuguauggccuggagcuccagcucuugccaugacggaaaagccuggcugcacguguguauuacaggcgaugacaagaacgcuaccgccuccuucaucuauaauggcaaacuuguugauagcguggucucuugguccaaggagauucugcggacccaggaaagcgagugcguguguaucaacgggacaugcacgguggucaugaccgacggaucugcuuccggcaaagccgauacaaagauucucuuuaucgaggaagggaagaucguucauaccagcacacuguccggaucugcgcaacacguggaggaaugcagcuguuacccccgcuauccuggcgugagaugcgucugucgggacaacuggaaaggguccaaucgccccauuguggauaucaacauuaaggaccacagcaucguuucuuccuacgugugcagcggacuugucggcgacaccccgcggaaaaaugauucuagcuccucuagccauugucuggacccuaacaaugaggaaggcgggcacggagugaagggcugggccuucgaugacgggaacgauguuuggaugggaagaacgauuaaugagacaucccgccucggcuacgagaccuuuaaagugaucgaaggguggagcaaccccaagucuaaacugcagaucaauagacaggucauuguggaccggggagaucgcuccggcuauagcggcaucuucucugucgaggggaaguccugcauuaacagauguuuuuacguggaacugauccggggaagaaaggaggaaaccgagguucucuggacaagcaauuccauuguggucuucugcggcaccucugggacauauggaacgggcagcuggccugacggggcugauaucaaccugaugcccauuuga

SEQ ID NO: 206475 - RNA, 1410 nt, Artificial Sequence
  derived and/or modified sequence opt5 from neuraminidase__InfluenzaA__AGK63044
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugaacugggcgugcccuuucaccucgggaccaagcaggucuguauggccugguccucuagcuccugccaugacggaaaagccuggcugcacguguguauuacaggcgaugacaagaacgcuaccgccagcuucaucuauaauggcaaacuuguugauucuguggucuccuggagcaaggagauucugcggacccaggaaucugagugcguguguaucaacgggacaugcacgguggucaugaccgacggauccgcuagcggcaaagccgauacaaagauucucuuuaucgaggaagggaagaucguucauaccuccacacugucuggaagcgcgcaacacguggaggaaugcuccuguuacccucgcuaucccggcgugagaugcgucugucgggacaacuggaaagggagcaaucgcccuauuguggauaucaacauuaaggaccacucuaucguuuccagcuacgugugcucuggacuugucggcgacacccccagaaagaaugauagcuccucuagcucccauugucuggacccgaacaaugaggaaggcgggcacggagugaaaggcugggccuucgaugacgggaacgauguuuggaugggacggacgauuaaugagacaagccgccucggcuacgagaccuuuaaagugaucgaaggguggucuaacccuaaguccaaacugcagaucaauagacaggucauuguggaccggggauaucgcagcggcuacucuggcaucuucuccgucgagagcaaguccugcauuaacagauguuuuuauguggaacugcuccgggggagaaaggaggaaaccgagguucuguggacaucuaauagcaucguggucuucugcggaaccuccggcacauacgggacgggaucuuggcccgauggcgcugacauuaaccuuaugccuaucuga

SEQ ID NO: 206476 - RNA, 1410 nt, Artificial Sequence
  derived and/or modified sequence opt5 from neuraminidase__InfluenzaA__AGK63046
augaaccccaaucagaagaucauuaccaucggcagcgugucccugacaauuucuacgaucugcuucuuuaugcaaauugccauccucaucaccacagucacccugcacuucaaacauuacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaguucgcucuggggcaaggaaccacacuuaauaacgugcacagcaauaacaccguucgggaucgcacgcccuauagaacacugcucaugaaugaacugggcgugccuuuucaucuggggaccaagcaggucugcauugccugguccucuagcuccugucacgacggaaaagccuggcuccaugugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucacaccuccacacucucuggaagcgcgcagcacguggaggaaugcuccugcuaucccagauacccuggcgugcggugugucugccgcgacaacuggaaggggagcaauagacccaucguggauauuaacaucaaagaccauucuauuguuuccagcuacguguguucuggacuggucggcgacaccccgcggaagaaugauagcuccucuagcucccacugccuugacccuaacaaugaggaaggcgggcauggagugaaaggcugggccuucgaugacgggaacgauguuuggaugggacgcacgaucaaugagacaagcagacugggcuaugagaccuuuaaggugaucgaaggguggucuaaccccaaauccaagcuccaaauuaaucggcaggucaucguggaccgcggagauagaagcggcuacucuggcauuuucuccgucgaggggaaaagcuguaucaaccggugcuuuuauguggaccugauuagaggacgcaaggaagagaccgaaguucuguggacauccaauucuaucguggucuucuguggcaccagcgggacauacggaacgggcuccuggccugauggggcugacauuaaccucaugcccaucuga

SEQ ID NO: 206477 - RNA, 1398 nt, Artificial Sequence
  derived and/or modified sequence opt5 from neuraminidase__InfluenzaA__AGK82159
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccguccgcauuggggagagcuccgauguucuggugaccagagaacccuaugugucuugcgacccugaugagugucgguuuuacgcccucagccagggaacaaccauccgcggcaagcauuccaacgagacaauccacgacagaagccaauaucgggcucugauuucuuggccccuguccagcccucccaccgucuacaacucucgcguggaaugcaucggcugguccagcacgucuugucaugaugggaaauccagaaugagcauuugcaucuccggaccuaauaacaaugccucugcuguugugugguauaaccggcgcccggucgccgagauuaauacaugggcgagaaacauccuccggacccaggaaagcgagugugugugccacaauggcguuugucccguggucuucacagacggguccgccaccggaccugcugauacccgcaucuacuacuuuaaggagggcaagauucugaaaugggaaagccuuacagggacggccaagcacaucgaggaaugcucuugcuauggagagagaaccggcauuacauguaccugccgggacaacuggcagggcuccaaucgccccgugauccagauugauccuguggcuaugacacauaccagccaauacaucuguucucccguccugacggacaacccgagaccuaaugaucccaacaucgggaaaugcaaugacccuuaucccggaaacaauaacaacggcguuaagggguucagcuaccucgauggagccaauacauggcugggccggaccauuuccaccgcgucuagaagcggguaugaaaugcuuaaagugcccaacgcccugacagacgaccgcuccaagccuauccagggacagaccauugugcucaaugcugauuggagcggcuacucuggcuccuuuauggacuauugggccgagggggauuguuaccgggcuugcuucuacgucgagcugaucagaggacgcccgaaggaagacaaagugugguggacaagcaacucuauuguuuccauguguagcuccacggaguuucugggccaguggaauuggcccgauggggccaagaucgaauauuuccucuga

SEQ ID NO: 206478 - RNA, 1398 nt, Artificial Sequence
  derived and/or modified sequence opt5 from neuraminidase__InfluenzaA__AGK84858
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccguccgcauuggggagagcuccgauguucuggugaccagagaacccuaugugucuugcgacccugaugagugucgguuuuacgcccucagccagggaacaaccauccgcggcaagcauuccaacggcacaauccacgacagaagccaauaucgggcucugauuucuuggccccuguccagcccucccaccgucuacaacucucgcguggagugcaucgggugguccagcacgucuugucaugauggaaaauccagaaugagcauuugcaucuccggcccuaauaacaaugccucugcuguugugugguauaaccggcgcccggucgccgaaauuaauacaugggcgagaaacauccuccggacccaggagagcgaaugugugugccacaaugggguuugucccguggucuucacagacggauccgccaccggcccugcugauacccgcaucuacuacuuuaaggaggggaagauucugaaaugggagagccuuacaggaacggccaagcacaucgaagagugcucuugcuauggcgaaagaaccggcauuacauguaccugccgggacaacuggcagggguccaaucgccccgugauccagauugauccuguggcuaugacacauaccagccaauacaucuguucucccguccugacggacaacccgagaccuaaugaucccaacaucggaaaaugcaaugacccuuaucccggcaacaauaacaacgggguuaagggauucagcuaccucgauggcgccaauacauggcuggggcggaccauuuccaccgcgucuagaagcggauaugagaugcuuaaagugcccaacgcccugacagacgaccgcuccaagccuauccagggccagaccauugugcucaaugcugauuggagcggcuacucuggguccuuuauggacuauugggccgaaggagauuguuaccgggcuugcuucuacgucgagcugaucagaggccgcccgaaggaggacaaagugugguggacaagcaacucuauuguuuccauguguagcuccacggaauuucuggggcaguggaauuggcccgauggagccaagaucgaguauuuccucuga

SEQ ID NO: 206479 - RNA, 1398 nt, Artificial Sequence
  derived and/or modified sequence opt5 from neuraminidase__InfluenzaA__AGK84861
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuaccaacauccagauggaggaaagaacaucucggaauuucaacaaucugaccaaggggcuuuguacgauuaacagcuggcacaucuacggaaaagacaaugccguccgcauuggcgaguccucugauguucuggugaccagagaacccuaugugagcugcgacccugaugagugucgguuuuacgcccucucccaggggacaaccauccgcggaaagcauagcaacggcacaauccacgacagaucucaauaucgggcucugauuuccuggccccugagcucuccucccaccgucuacaacucccgcguggagugcaucggcuggagcucuacguccugucaugaugggaaaagcagaauguccauuugcaucucuggaccuaauaacaaugccagcgcuguugugugguauaaccggcgcccggucgccgaaauuaauacaugggcgagaaacauccuccggacccaggaguccgaaugugugugccacaauggcguuugucccguggucuucacagacgggagcgccaccggaccugcugauacccgcaucuacuacuuuaaggagggcaagauucugaaaugggagucucuuacagggacggccaagcacaucgaagagugcuccugcuauggagaaagaaccggcauuacauguaccugccgggacaacuggcagggcagcaaucgccccguggugcagaucgauccugucgcuaugacacauaccucucaauacauuuguagccccguucugacggacaacccgagaccuaaugaucccaacaucgggaaaugcaaugacccuuaucccggaaucaacaauaacggcgugaagggguucuccuaccucgauggagccaacacauggcugggccggaccauuucuaccgcgagcagauccggguaugagaugcuuaaagugcccaaugcccugacagacgaccgcagcaagccuauccagggacagaccauuguccucaacgcugauuggucuggcuacuccggcagcuuuauggacuauugggccgaaggggauuguuaccgggcuugcuucuacguggagcugaucagaggacgcccgaaggaggacaaaguuugguggacaucuaauuccauugugagcauguguuccucuacggaauuucugggccaguggaacuggcccgauggggccaagaucgaguauuuccucuga

SEQ ID NO: 206480 - RNA, 1398 nt, Artificial Sequence; identical to SEQ ID NO: 206478
  derived and/or modified sequence opt5 from neuraminidase__InfluenzaA__AGK84864

SEQ ID NO: 206481 - RNA, 1398 nt, Artificial Sequence
  derived and/or modified sequence opt5 from neuraminidase__InfluenzaA__AGL95090
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaacaauauccagauggaggaaagaaccucccggaacuucaauaaccugacaaagggacuuuguaccauuaauucuuggcacaucuacggcaaagacaacgccguccgcauuggggagagcuccgauguucuggugacgagagaacccuaugugucuugcgacccugaugagugucgguuuuacgcccucagccagggaaccacaauccgcggcaagcauuccaacggcaccauccacgacagaagccaauaucgggcucugauuucuuggccccuguccagcccucccacagucuacaauucucgcguggagugcaucgggugguccagcaccucuugucaugauggaaaauccagaaugagcauuugcaucuccggcccuaacaauaacgccucugcuguugugugguauaaucggcgcccggucgccgaaauuaacacgugggcgagaaauauccuccggacacaggagagcgaaugugugugccacaacgggguuugucccguggucuucaccgacggauccgccacaggcccugcugauacccgcaucuacuacuuuaaggaggggaagauucugaaaugggagagccuuaccggaacagccaagcacaucgaagagugcucuugcuauggcgaaagaacgggcauuaccuguacaugcaaagacaauuggcagggguccaaccggcccgugauccagauugauccuguggcuaugacccauacaagccaauacaucuguucucccguccugaccgacaauccgcgcccuaacgaucccaauaucggaaagugcaacgacccuuaucccggcaauaacaacaaugggguuaaaggauucagcuaccucgauggcgccaacacguggcuggggagaacaauuuccaccgcgucucggagcggauaugagaugcuuaaggugcccaaugcccugaccgacgacagauccaagccuauccagggccagacaauugugcucaacgcugauuggagcggcuacucuggguccuuuauggacuauugggccgaaggagauuguuaccgcgcuugcuucuacgucgagcugauccggggcagaccgaaagaggacaaggugugguggaccagcaauucuauuguuuccauguguagcuccacagaauuucuggggcaguggaacuggcccgauggagccaaaaucgaguauuuccucuga

SEQ ID NO: 206482 - RNA, 1413 nt, Artificial Sequence; identical to SEQ ID NO: 199656
  derived and/or modified sequence opt5 from neuraminidase__InfluenzaA__AGL96802

SEQ ID NO: 206483 - RNA, 1413 nt, Artificial Sequence; identical to SEQ ID NO: 199656
  derived and/or modified sequence opt5 from neuraminidase__InfluenzaA__AGL96807

SEQ ID NO: 206484 - RNA, 1413 nt, Artificial Sequence
  derived and/or modified sequence opt5 from neuraminidase__InfluenzaA__AGL96808
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuaccguggauggcgccaacggggugaaaggauucuccuacaaguaugacaauggcgucuggaucgggcggacaaaaagcaaccgccugagaaagggauuugagaugauuugggaccccaauggcuggacgaacaccgauucuuucuuuuccgugaaacaggacguuguggcgaucacagauuggagcggguacuccggcucuuucguccagcacccggaacucaccggacuggacugcauccggccuuguuucuggguggagcuuguucgcggccugcccagagaaaacacaaccauuuggacgagcggguccucuaucagcuuuugcggagucaauuccgauacagccaacuggagcuggccugacggcgcugagcuccccuucaccauugauaaguga

SEQ ID NO: 206485 - RNA, 1413 nt, Artificial Sequence
  derived and/or modified sequence opt5 from neuraminidase__InfluenzaA__AGL96809
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaagacagcuagcuacaaaaucuucaagauugaaaagggaaaagugaccaaguccaucgagcugaacgccccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuacaguggauggcgcuaacggggugaaaggauucuccuacaaguaugacaauggcgucuggaucgggcggacgaaaagcaaccgccugagaaagggauuugagaugauuugggaccccaauggcuggaccaacacagauucugacuucuccgugaaacaggauguuguggccaucaccgacuggagcggguacuccggcucuuuuguccagcacccggaacucacaggacuggauugcauccggccuuguuucuggguggagcuuguucgcggccugcccagagaaaacaccacgauuuggacaagcggguccucuaucagcuucugcggagucaauuccgacaccgcgaacuggagcuggccugauggcgccgagcuccccuuuaccauugacaaguga

SEQ ID NO: 206486 - RNA, 1413 nt, Artificial Sequence; identical to SEQ ID NO: 199656
  derived and/or modified sequence opt5 from neuraminidase__InfluenzaA__AGL96818

SEQ ID NO: 206487 - RNA, 1413 nt, Artificial Sequence
  derived and/or modified sequence opt5 from neuraminidase__InfluenzaA__AGL96820
augaaccccaaucagaagaucauuaccacaggcagcaucuccauugccaucgggauuaucucucugaugcuccaaaucggaaacauuaucagcauuugggcuucccacucuauccagacgggcagccagaauaacaccgggauuugcaaucagagaaucauuacauacgagaacuccaccugggugaaucauacauaugugaacaucaauaacaccaauguuguggccggagaagacaaaacaucugugacccuggcgggcaacagcucccuuuguagcaucucugggugggcuauuuacacgaaggauaauuccauccggauuggaagcaaaggcgacgucuucgugauccgcgagccuuuuauuucuugcucccaccuggaauguagaaccuucuuucucacacaaggcgcccugcuuaacgauaagcauagcaaugggaccguuaaagaccggucuccguaucgcgcccugauguccugcccccucggagaggcuccuagccccuacaacuccaaguucgaaucuguggccuggagcgcuuccgccugucacgauggcaugggguggcugacaaucggaaucagcggcccugacaacggggcggucgccgugcugaaguauaauggaauuaucaccggcacgauuaaaucuuggaagaaacagauccucagaacacaggaguccgagugcguuuguaugaacggcagcugcuuuaccauuaugacagaugggcccucuaauaaggcugccagcuacaaaaucuucaagaucgaaaagggaaaagugaccaaguccauugagcugaacgcuccuaauuuucauuaugaagaguguucuugcuacccggacaccggcaucgucaugugugugugccgggauaacuggcacgggagcaaucgccccuggguguccuucaaccagaaucuugacuaccaaauuggauauaucugcagcggcgucuuuggggauaacccuagacccgaggacggagaaggcucuuguaauccuguuacaguggauggcgccaacggggugaaaggauucuccuacaaguaugacaauggcgucuggauugggcggacgaaaagcaaccgccugagaaagggauuugagaugaucugggaccccaauggcuggaccaacacagauucugacuucuccgugaaacaggauguuguggcgauuaccgacuggagcggguacuccggcucuuuuguccagcacccggaacucacaggacuggauugcauccggccuuguuucuggguggagcuuguucgcggccugcccagagaaaacaccacgaucuggacaagcggguccucuauuagcuucugcggagucaauuccgacaccgccaacuggagcuggccugauggcgcugagcuccccuuuaccaucgacaaguga

SEQ ID NO: 206488 - RNA, 1413 nt, Artificial Sequence
  derived and/or modified sequence opt5 from neuraminidase__InfluenzaA__AGL96821
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuuccguggauggcgccaacggggugaaaggauucagcuacaaguaugacaauggcgucuggaucgggcggaccaaaucuaaccgccugagaaagggauuugagaugauuugggaccccaauggcuggacaaacacggauuccgacuucagcgugaaacaggauguuguggcgaucaccgacugguccggguacucuggcagcuuuguccagcacccggaacucacaggacuggauugcauccggccuuguuucuggguggagcuuguucgcggccugcccagagaaaacaccacaauuuggaccuccgggucuagcaucuccuucugcggagugaauagcgacacggccaacuggucuuggccugauggcgcugagcuccccuuuacaauugacaaguga

SEQ ID NO: 206489 - RNA, 1410 nt, Artificial Sequence
  derived and/or modified sequence opt5 from neuraminidase__InfluenzaA__AGN69269
augaucaccaaccagagaauuaucacaauuggcacggugugccugaucgucgggauuguuagccuccugcuucaaaucggaaauaucgugucccuguggauuucucacagcauccagaccggcgagaagaaccauuccgaaauuuguaaucagaacacaaucaccuacgagaauaacacaugggugaaucagaccuaugucaacauuucuaauacaaacaucgccgacgggcaaggagugaccagcauuauccucgcuggcaauuccucucugugccccaucagcgggugggccauuuacuccaaagauaacagcauccggauuggaucuaagggcgacaucuucguuauucgcgaaccuuuuaucuccuguagccaccuugagugcagaacguucuuucugacccagggcgcgcuccugaaugaucggcauucuaacgggacagugaaagaccgcuccccguauagaacccugaugagcugucccaucggagaagcuccuucucccuacaauucccgguucgagagcgucgccugguccgccucugcuugccacgauggcaugggguggauuacaaucggaauuagcggcccugacaacggggccguggcuguucucaaguauaacggaaucauuaccgauacgaucaaauccuggcgcaauaagauccugagaacacaggagagcgaaugugugugcauuaacggcucuuguuuuaccaucaugacagacggccccuccaaugggcaggccagcuacaagauuuucaaaauggagaagggaaaaaucauuaagucugucgaacuugaugcgccuaacuaucauuacgaggagugcagcuguuacccggacaccggcaaaguggugugcgucugccgggauaauuggcacgccuccaaccgccccuggguuucuuuugaccaaaaucuggauuaucagaucggguacauuuguagcggaguguucggcgacaacccuagauccaaugacgggaagggaaacugcggccccgcucucagcaauggcgccaacggggugaagggauuuucuuuccgguauggcaauggggucuggaucggacgcaccaaauccaucagcucuagauccggcuuugaaaugauuugggauccuaacggguggacagagacggacagcuccuucucuaugaagcaggauaucauugcucugaccgacuggagcggcuacuccggaucuuuugugcagcaccccgaacuuacaggcaugaauuguauccggccgugcuucuggguugagcugauucgcgggcaaccuaaagaaagcaccaucuggacauccggaagcucuaucuccuucuguggcguggauagcgagaccgccucuugguccuggcccgacggggcggaucucccuuuuacgauugacaaguga

SEQ ID NO: 206490 - RNA, 1410 nt, Artificial Sequence
  derived and/or modified sequence opt5 from neuraminidase__InfluenzaA__AGN69280
augaacaccaaucagagaaucauuacaaucggcacggugugccugauugucgggaucguuagccuccugcuucaaauuggaaacaucgugucccuguggaucucucacagcauucagaccggcgagaagaaucauuccgaaaucuguaaccagaauacaauuaccuacgagaacaauacaugggugaaccagaccuaugucaauaucucuaacacaaauauugccgacgggcaaggagugaccagcaucauucucgcuggcaacuccucucugugccccaucagcgggugggccaucuacuccaaagauaauagcauucggaucggaucuaagggcgacauuuucguuauccgcgaaccuuuuauuuccuguagccaccuugagugcagaacguucuuucugacccagggcgcgcuccugaacgaucggcauucuaaugggacagugaaagaccgcuccccguauagaacccugaugagcugucccaucggagaagcuccuucucccuacaacucccgguucgagagcgucgccugguccgccucugcuugccacgauggcaugggguggcucacaaucggaauuagcggcccugacaacggggccguggcuguucugaaguauaauggaaucauuaccgauacgaucaaauccuggcgcaacaagauucuuagaacacaggagagcgaaugugugugcaucaauggcucuuguuuuaccaucaugacagacggccccuccaacgggcaggccagcuacaagauuuucaaaauggagaagggaaaaaucauuaagucugucgaacuggaugcgccuaauuaucauuacgaggagugcagcuguuacccggacaccggcaaaguggugugcgucugccgggauaacuggcacgccuccaaucgccccuggguuucuuuugaccaaaaccucgauuaucagaucggguacauuuguagcggaguguucggcgacaauccuagauccaacgacgggaagggaaauugcggccccgugcugagcaacggcgcuaauggggucaagggauuuucuuuccgguauggcaacgggguguggaucggacgcaccaaauccauuagcucuagauccggcuuugaaaugaucugggauccuaauggguggacagagacggacagcuccuucucuaugaagcaggauaucauugcccuuaccgacuggagcggcuacuccggaucuuuuguucagcaccccgaacugacaggcaugaacuguauccggccgugcuucuggguggagcucauucgcgggcaaccuaaagaaagcaccaucuggacaggaggcuccagcauuucuuucuguggggucgauuccgagaccgcuagcuggucuuggcccgacggagccgaucugccuuuuacgaucgacaaguga

SEQ ID NO: 206491 - RNA, 1410 nt, Artificial Sequence
  derived and/or modified sequence opt5 from neuraminidase__InfluenzaA__AGN69292
augaaccccaaucagaagaucauuaccaucggcagcauuugcaugacaaucgggauugccucccugauccuccaaaucggaaacauuaucucuauuuggaucagccacuccauucagacggagaaucagaaccagccugaaaucuguaaucaaaacgugauuaccuacgagaauaacacaugggucaaucagaccuauguuaacaucucuaauacaaacuucguggcugaacaggccguggcgagcgucaaacuggcuggcaauuccucucuuugcccggugagcgggugggccaucuacuccaaggacaacagcguuagaauuggaucuaaaggcgauguguuugucauccgggagcccuucauuuccuguagccaucuggaaugccgcaccuuuuuccucacacagggggcccugcuuaaugacaagcacucuaacggaaccaucaaagauagauccccuuaucggacgcugaugagcugucccauuggcgaggugccuucucccuacaacucccgcuuugagagcguugcuugguccgccucugcuugccaugacggcaccagcuggcucacaaucgggaucuccggaccugauaauggcgccguggcgguccugaaguauaacgggauuaucaccgacacaauuaagagcuggagaaagaauauccugcggacccaagaaucugagugugccugcgugaacggauccuguuucacggugaugacagauggcccgagcaaugggcaggcuucuuacaaggucuuuaaaauugaaaagggaaaaguugugaaaagcguggagcucaacgcccccaauuaucacuacgaggaaugcuccuguuacccugagucuggcgaaauuaccugcgucugccgcgacaacuggcauggcagcaauagacccuggguguccuucaaccagaaucuggaguaucagaugggguacaucuguagcggaaucuuuggcgauaacccucggcccaaugacaagacagggucuugcggaccgguuuucuccaacggcgcuaauggggugaaaggauuuagcuucaaguauggcaacggcgucuggaucgggcgcaccaaaucuauuuccagcagaaugggauuugaaaugaucugggauccugacggcuggaccaagacagaugacaaauucuccgugaagcaagacauuaucgggauuaacgauuggucuggauacagcggcuccuucguucagcaccccgagcuuacggggcuggacuguaugcggccuugcuuuuggguggagcucauccgcggcagacccaaagaaaauaccaucuggacaucuggaagcuccauuagcuucuguggcgucaacucugauaccguggggugguccuggcccgacggagccgagcugccuuuuacaaucgauaaguga

SEQ ID NO: 206492 - RNA, 1410 nt, Artificial Sequence
  derived and/or modified sequence opt5 from neuraminidase__InfluenzaA__AGN69316
augaaccccaaucagaagaucauuaccaucggcagcauuugcaugacaaucgggauugccucccugauccuccaaaucggaaacauuaucucuauuuggaucagccacuccauucagacggagaaucagaaccagccugaaaucuguaaucaaaacgugauuaccuacgagaauaacacaugggucaaucagaccuauguuaacaucucuaauacaaacuucguggcugaacaggccguggcgagcgucaaacuggcuggcaauuccucucuuugcccggugagcgggugggccaucuacuccaaggacaacagcguuagaauuggaucuaaaggcgauguguuugucauccgggagcccuucauuuccuguagccaucuggaaugccgcaccuuuuuccucacacagggggcccugcuuaaugacaagcacucuaacggaaccaucaaagauagauccccuuaucggacgcugaugagcugucccauuggcgaggugccuucucccuacaacucccgcuuugagagcguugcuugguccgccucugcuugccaugacggcaccagcuggcucacaaucgggaucuccggaccugauaauggcgccguggcgguccugaaguauaacgggauuaucaccgacacaauuaagagcuggcggaaaaauauccugagaacccaagaaucugagugugccugcgugaacggauccuguuucacggugaugacagauggcccgagcaaugggcaggcuucuuacaaggucuuuaaaauugaaaagggaaaaguugugaagaccguggagcucaacgcccccaauuaucacuacgaggaaugcagcuguuacccugaguccggcgaaaucacaugcgucugccgcgacaacuggcauggcucuaauagacccugggugagcuucaaccagaaucuggaguaucagaugggguacaucuguuccggaauuuuuggcgauaacccucggcccaaugacaagaccgggagcugcggaccgguuuucucuaacggcgcuaauggggugaaaggauuuuccuucaaguauggcaacggcgucuggaucgggcgcaccaaaagcauuucuuccagaaugggauuugaaaugaucugggauccugacggcuggacaaagacggaugacaaauucagcgugaagcaagacauuaucgggauuaacgauugguccggauacucuggcagcuucguucagcaccccgagcuuaccgggcuggacuguaugcggccuugcuuuuggguggagcucauccgcggcagacccaaagaaaauacaaucuggaccuccggaucuagcauuuccuucuguggcgucaacagcgauacagugggguggucuuggcccgacggagccgagcugccuuuuaccaucgauaaguga

SEQ ID NO: 206493 - RNA, 1410 nt, Artificial Sequence; identical to SEQ ID NO: 206492
  derived and/or modified sequence opt5 from neuraminidase__InfluenzaA__AGN69328

SEQ ID NO: 206494 - RNA, 1410 nt, Artificial Sequence
  derived and/or modified sequence opt5 from neuraminidase__InfluenzaA__AGN69340
augaaccccaaucagaagaucauuaccaucggccugauuugcaugacaaucgggauugccagccucauccugcaaaucggaaacauuaucuccauuuggaucucucacagcauucagacggagaaucagaacaaaccugaaaucuguaaucagaacgugauuaccuacgagaauaacacaugggucaaucaaaccuauguuaacguguccaauacaaacuucguggcugaacaggccgucgcgucugugaaacuuguuggcaauagcucccugugcccggugucugggugggcuaucuacagcaaggacaacuccgucagaaucggaagcaagggcgauguguuuguuauucgggagcccuucaucucuuguucccaucucgaaugccgcaccuuuuuccugacacagggggcccuucugaaugacaaacacagcaacggaaccauuaaggauagaucuccuuaucggacgcucauguccugucccaucggcgaggugccuagccccuacaacucucgcuuugaguccgucgccuggagcgcuuccgccugccaugacggcaccucuuggcugacaauugggaucagcggaccugauaauggcgcuguggccgugcugaaguauaacgggaucauuaccgacacaaucaaauccuggagaaagaauauucuccggacccaggaaagcgagugugcgugcgucaacggaucuuguuucacgguuaugacagauggcccguccaaugggcaagccagcuacaaaguguuuaagaucgaacgcggaaaaguggucaagucuguggagcugaacgcucccaauuaucacuacgaggaaugcagcuguuacccugaguccucugaaauuaccugcguuugcagagacaacuggcauggcagcaaucggcccuggguguccuucaaccagaaucuugaguaucagaugggcuacaucuguagcggggucuuuggagauaacccucgccccaaugacaagacaggcucuugcgggccgguguucuccaacggagccaauggcguuaaaggguuuagcuucaaguauggaaacggcguguggaucggcagaaccaaaucuaccuccagccggaugggguuugaaaugauuugggauccugacggauggacaaagacggaugacaaauucuccgucaagcaggacaucauuggcaucaccgauuggucuggguacagcggauccuucgugcaacaccccgagcugacaggccucgacuguaugcgcccuugcuuuugggucgagcugauuagagggcggcccaaagaaaacaccaucuggacaucuggcagcuccauuagcuucuguggaguuaauucugauaccgugggcugguccuggcccgacggggcugagcuuccuuuuacgaucgauaaguga

SEQ ID NO: 206495 - RNA, 1410 nt, Artificial Sequence
  derived and/or modified sequence opt5 from neuraminidase__InfluenzaA__AGO00268
augaaccccaaucagaagaucauuaccaucggcagcauuugcaugguggucgggaucauuucccugauccuccaaaucggaaacauuaucucuauuuggaucagccacuccauucagacaggcucucagaaucauacggggaucuguaaccagagcauuaucaccuacaaaaauuccacauggguuaaccaaaccuaugugaauaucucuaacacaaauguggucgccggaaaggacaccacaagcaugauucuggcuggcaacuccagccuuugcccuaucagagggugggccauuuacucuaaagauaauggaauccggauuggcuccaagggcgacguguucguuauccgcgagccguuuaucagcuguucucaccuggaaugcagaaccuucuuucucacgcagggggcgcugcuuaacgauaaacauuccaauggaaccgugaaggaccggagccccuaucgcgcucugaugucuuguccugucggcgaggcccccuccccuuacaacagcagauucgaauccguggccuggucugcuagcgccugccacgaugggaugggauggcucacaauuggcaucuccgggcccgacgauggagcuguugccgugcugaaguauaauggcauuaucaccgagacaauuaaaagcuggaagaaaaagauccugcggacccaggaaucugagugugucugcgugaacggcuccuguuuuacgaucaugacagacgggccuagcgauggaccggcgucuuacaaaauuuucaagaucgagaagggcaaagugaccaagagcauugaacucgacgcccccaacucccauuaugaggaaugcucuuguuacccugauacagggaaagucaugugcguuugccgcgacaauuggcacggaagcaacagacccuggguguccuuugaucagaaucuggacuaccaaaucggcuauauuuguagcgggguguucggagacaacccucggcccaaggauggcaaaggcucuugcgggccggucuacguggacggagcuaauggcguuaagggguuuuccuaucgcuacggagauggcguguggaucgggagaaccaaaagcaacucuucccggcagggcuucgagaugauuugggacccuaauggauggaccgagacagauagcuccuuuuucgucaagcaggacgugguugccaugacggauuggucuggcuauagcggguccuuugugcagcaccccgaacuuaccggacugaacuguaugcgcccuugcuucugggucgagcucaucagaggccggcccaaggagaaaacaaucuggaccucugggagcuccauuagcuucuguggagucaauucugacacaguggauugguccuggcccgacggcgcugaacugccuuuuaccaucgauaaguga

SEQ ID NO: 206496 - RNA, 1410 nt, Artificial Sequence
  derived and/or modified sequence opt5 from neuraminidase__InfluenzaA__AGO00280
augaaccccaaucagaagaucauuaccaucggcagcauuugcaugguggucgggaucauuucccugauccuccaaaucggaaacauuguuucuaucuggauuagccacuccauccagacaggcaaucagaaccauacggggaccuguaaucagucuauuaucacauacaaaaacagcaccugggugaaucaaacauaugugaacauuuccaauaccaacgucguggccggaaaggacacaaccucuguuauccuggcuggcaauagcucccuuugcccuaucagagggugggccauuuacagcaaagauaacggagugcggaucggcucuaagggcgacgucuucgugauucgcgagccguuuaucuccuguagccaccuggaaugcagaacguucuuucucacccagggggcgcugcuuaaugauaaacauucuaacggaacaguuaaggaccggucccccuaucgcgcucugaugagcuguccugugggcgaggcccccucuccuuacaauuccagauucgaaagcgucgccugguccgcuucugccugccacgaugggaugggauggcucaccauuggcaucagcgggcccgacgauggagcuguggccgugcugaaguauaacggcaucauuacagagaccaucaaauccuggcggaaggaaauucugcgcacgcaggagagcgagugugucugcguuaacggcucuuguuuuacaaucaugaccgacgggccuuccggaggcccggcgagcuacaaaauuuucaagaucgaaaaagggaaggugacaaagucuaucgagcucgaugcccccaauagccauuaugaagagugcuccuguuacccugacaccucuaaagugaugugcgucugcagagauaacuggcacggaagcaaucggcccuggguguccuuugaccagaaccuggauuaccaaaugggcuauauuuguagcgggguuuucggagacaauccucgccccaaggacggcaaaggcucuugcgggccgguguacgucgauggagcuaacggcgugaagggguuuuccuauagauacggaaauggcguuuggaucgggcggaccaaaagcaacucuucccgccagggcuucgagaugauuugggacccuaauggauggacagaaacggauagcaacuuuuucaugaagcaggacguggucgccgugaccgauugguccggcuauucugggagcuuuguccagcaccccgagcuuacaggacuggacuguaugagaccuugcuucuggguggaacucauccggggccgccccaaagagaauaccauuuggacauccgggucuagcaucuccuucuguggaguuaacagcgauaccguggacuggucuuggcccgauggcgcugaacugccuuuuacgauugacaaguga

SEQ ID NO: 206497 - RNA, 1413 nt, Artificial Sequence
  derived and/or modified sequence opt5 from neuraminidase__InfluenzaA__AGO00292
augaaccccaaucagaagaucauuaccaucggcagcauuugcaugacaaucgggacgauuucccugauccuccaaaucggaaacauuaucucuauuuggaucagccacuccauucagaccggcucucagaaucauacagggaucuguaaccagagaauuaucaccuacgagaauaacacaugggugaaucaaaccuaugucaacaucagcaauacaaacguuguggccggaaaagacaccacguccaugauucuggcuggcaauucuagccuuugcccuauccgggggugggccauuuacuccaaggauaacagcauccgcauuggaucuaaaggcgacguguucgucaucagagaaccguuuaucuccuguagccaccuggagugccggaccuucuuucucacacagggcgcgcugcuuaaugauaagcauucuaacgggaccgugaaagaccgcucccccuauagagcucugaugagcuguccuauuggagaagcccccucuccuuacaauucccgguucgagagcguugccugguccgcuucugccugccacgauggcaugggguggcucacaaucggaauuagcggccccgacgauggggcuguggccguccugaaguauaacggaaucauuaccgaaaucaucaaguccuggcgcaaacagauucugagaacgcaggagagcgagugugugugcguuaacggcucuuguuuuacaaucaugaccgacggcccuuccgaugggccggcgagcuaccggauuuucaagaucgaaaaaggaaagauuacaaaaucuaucgagcucgacgcccccaauagccauuaugaagagugcuccuguuacccugauaccggcaaggugaugugcgucugccgcgacaacuggcacgggucuaauagacccugggugagcuuuaaccaaaaucuggauuaccagauuggauauaucuguuccggcguguucggggacaacccucggcccaaggacggaaaaggcagcugcgauccggucaauguugacggcgcugauggggugaagggauuuucuuaccgcuauggcgacgggguguggaucggaagaaccaaauccaacagcucucggaagggcuucgagaugauuugggauccuaauggguggacagacacggaugacaacuuucuugucaaacaggaugugguugccaugaccgacugguccggcuacagcggauccuucgugcagcaccccgaacugacaggccucgauuguauccgcccuugcuuuugggucgagcugauuagagggcggcccagagaaaagaccacaaucuggaccucuggaagcuccauuucuuucuguggcgugaauagcgacacgguuaacugguccuggcccgacggggcugagcuuccuuucacaaucgauauguga

SEQ ID NO: 206498 - RNA, 1413 nt, Artificial Sequence
  derived and/or modified sequence opt5 from neuraminidase__InfluenzaA__AGO00304
augaaccccaaucagaagaucauuaccaucggcagcauuugcauggccaucgggacaauuucccugauccuccaaaucggaaacauuaucucuauuuggaucagccacuccauucagacgggcucucagaaucauaccgggaucuguaaccagagaauuaucacauacgagaauaacaccugggugaaucaaacauaugucaacaucagcaauaccaacguuguggcuggaaaagacacaaccuccaugauucuggccggcaauacgucucuuugcccuauccgggggugggcgauuuacagcaaggauaacuccauccgcauuggaagcaaaggcgacguguucgucaucagagaaccguuuaucucuuguucccaccuggagugccggaccuucuuucucacacagggcgcucugcuuaaugauaagcauagcaacgggaccgugaaagaccgcucucccuauagagcccugauguccuguccuauuggagaagcccccagcccuuacaauucucgguucgaguccguugcuuggagcgccuccgcuugccacgauggcaugggguggcucacaaucggaauuucuggccccgacgauggggccguggcgguccugaaguauaacggaaucauuaccgaaaucaucaagagcuggcgcaaacagauucugagaacgcaggaguccgagugugugugcguuaacggcagcuguuuuacaaucaugaccgacggcccuucuaaugggccggccuccuaccggauuuucaagaucgaaaaaggaaagauuacaaaaagcaucgagcucgaugcucccaacucucauuaugaagagugcagcuguuacccugacaccggcaaggugaugugcgucugccgcgauaauuggcacggguccaacagacccugggugucuuuuaaucaaaaccuggacuaccagauuggauauaucuguagcggcguguucggggauaauccucggcccaaggacggaaaaggcuccugcgacccggucaacguugauggcgccgacggggugaagggauuuagcuaccgcuauggcaaugggguguggaucggaagaaccaaaucuaacuccagccggaagggcuucgagaugauuugggauccuaauggguggacaaacacggacggcaauuuuucugucaaacaggaugugguugcuaugaccgacugguccggauacagcggcuccuucgugcagcaccccgaacuuacagggcuggauuguaugcgcccuugcuuuugggucgagcucaucagaggacggcccagagaaaagaccacaauuuggaccucuggcagcuccaucucuuucuguggggugaacagcgacacgguuaauugguccuggcccgauggagccgagcugccuuucacaauugacaaauga

SEQ ID NO: 206499 - RNA, 1410 nt, Artificial Sequence; identical to SEQ ID NO: 205568
  derived and/or modified sequence opt5 from neuraminidase__InfluenzaA__AGO00316

SEQ ID NO: 206500 - RNA, 1410 nt, Artificial Sequence; identical to SEQ ID NO: 205012
  derived and/or modified sequence opt5 from neuraminidase__InfluenzaA__AGO00328

SEQ ID NO: 206501 - RNA, 1410 nt, Artificial Sequence; identical to SEQ ID NO: 197119
  derived and/or modified sequence opt5 from neuraminidase__InfluenzaA__AGO00340

SEQ ID NO: 206502 - RNA, 1365 nt, Artificial Sequence; identical to SEQ ID NO: 198743
  derived and/or modified sequence opt5 from neuraminidase__InfluenzaA__AGO00352

SEQ ID NO: 206503 - RNA, 1365 nt, Artificial Sequence; identical to SEQ ID NO: 198743
  derived and/or modified sequence opt5 from neuraminidase__InfluenzaA__AGO00376

SEQ ID NO: 206504 - RNA, 1365 nt, Artificial Sequence; identical to SEQ ID NO: 198743
  derived and/or modified sequence opt5 from neuraminidase__InfluenzaA__AGO00388

SEQ ID NO: 206505 - RNA, 1365 nt, Artificial Sequence; identical to SEQ ID NO: 198743
  derived and/or modified sequence opt5 from neuraminidase__InfluenzaA__AGO00400

SEQ ID NO: 206506 - RNA, 1365 nt, Artificial Sequence; identical to SEQ ID NO: 198743
  derived and/or modified sequence opt5 from neuraminidase__InfluenzaA__AGO00412

SEQ ID NO: 206507 - RNA, 1365 nt, Artificial Sequence; identical to SEQ ID NO: 198743
  derived and/or modified sequence opt5 from neuraminidase__InfluenzaA__AGO00424

SEQ ID NO: 206508 - RNA, 1365 nt, Artificial Sequence
  derived and/or modified sequence opt5 from neuraminidase__InfluenzaA__AGO00436
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggguuaaggacaccacauccgugauccugaccggaaauucuagccucugcccuaucagaggcugggccauuuauuccaaagauaacagcauccggauugggucuaagggagacguguucgucauccgcgagccguuuauuuccuguagccaccuggaaugcagaacauucuuucuuacccaaggcgcucugcucaaugauaaacauucuuccggcacggugaaggaccggagccccuaccgcgcccugaugucuuguccuguuggggaggcgcccuccccuuauaacagcagauucgaauccguggcuuggucugccagcgccugccacgauggaaugggcuggcugaccaucgggaucuccggacccgacaauggcgcugucgccgugcucaaguacaacgggauuaucacagagaccauuaaaagcuggcggaagaaaauccugcgcacacaggaaucugagugugcuugcguuaauggauccuguuuuaccauuaugacggauggcccuagcgacggccuugccucuuauaagaucuucaaaaucgagaaggggaaggugacaaaaagcauugaacugaacgcgcccaauuccaacuacgaggaaugcucuuguuauccggauaccggaaaggucaugugcgugugcagagacaacuggcauggcagcaaucggccuuggguguccuuugaucagaaccucgacuaccagaucggguacauuuguagcggagucuucggcgauaauccccgcccugaggacgggacaggaucuugcggccccguuuauguggacggcgccaacggggugaaaggauuuuccuacagauauggcaauggggucuggaucggacggaccaagagccacucuucccgccacggcuucgagaugauuugggauccgaacggguggaccgaaacagacagcaaauuuuccgugagacaagauguuguggcuaugacggacuggucuggcuacagcggauccuucguccagcauccugagcugaccggccuugauuguaugcggcccugcuuuuggguggaacugauccgcgggagaccuaaggagaaaacaauuuggaccucugccagcuccaucagcuucuguggaguuaauucugacacaguggauugguccuggcccgacggcgcugaacuccccuucagcaucgauaaguga

SEQ ID NO: 206509 - RNA, 1365 nt, Artificial Sequence
  derived and/or modified sequence opt5 from neuraminidase__InfluenzaA__AGO00448
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggguuaaggacaccacauccgugauccugaccggaaauucuagccucugcccuaucagaggcugggccauuuauuccaaagauaacagcauccggauugggucuaagggagacguguucgucauccgcgagccguuuauuuccuguagccaccuggaaugcagaacauucuuucuuacccaaggcgcucugcucaaugauaaacauucuuccggcacggugaaggaccggagccccuaccgcgcccugaugucuuguccuguuggggaggcgcccuccccuuauaacagcagauucgaauccguggcuuggucugccagcgccugccacgauggaaugggcuggcugaccaucgggaucuccggacccgacaauggcgcugucgccgugcucaaguacaacgggauuaucacagagaccauuaaaagcuggcggaagaaaauccugcgcacacaggaaucugagugugcuugcguuaauggauccuguuuuaccauuaugacggauggcccuagcgacggccuugccucuuauagaaucuucaagaucgagaaagggaaggugacaaagagcauugaacugaacgcgcccaauucccauuacgaggaaugcucuuguuauccggauaccggaaaagucaugugcgugugccgggacaacuggcacggcagcaaccgcccuuggguguccuuugaucagaaucucgacuaccagaucggguacauuuguagcggagucuucggcgauaaccccagaccugaggacgggacaggaucuugcggccccguuuauguggacggcgccaauggggugaagggauuuuccuaccgguauggcaacggggucuggaucggacgcaccaaaagccacucuuccagacauggcuucgagaugauuugggauccgaauggguggaccgaaacagacagcaaguuuuccgugcggcaagauguuguggcuaugacggacuggucuggcuacagcggauccuucguccagcacccugagcugaccggccuugauuguaugcgccccugcuuuuggguggaacugaucagagggcggccuaaagagaagacaauuuggaccucugccagcuccaucagcuucuguggaguuaacucugacacaguggauugguccuggcccgacggcgcugaacuccccuucagcaucgauaaauga

SEQ ID NO: 206510 - RNA, 1410 nt, Artificial Sequence
  derived and/or modified sequence opt5 from neuraminidase__InfluenzaA__AGQ47722
augaacaccaaucagagaaucauuacaaucggcacgauuugccugaucguggggauuaucagccuccugcuucaaaucggaaacauuaucucccuguggauuucucacagcauccagaccggcgagaagucccaucccgaaauuuguaaucagucugucaucacauacgagaacaauaccuggguuaaccagacauaugugaauauuagcaacaccaauaucgccgcugggcaaggagugacaccuaucauucucgccggcaacuccucucugugcccgaucagcgggugggcgauuuacuccaaagacaauagcauccggauuggaucuaagggcgauaucuucgucaugcgcgaacccuuuaucuccuguagccaccuugagugcagaaccuucuuucugacgcagggcgcucuccugaacgaccggcauucuaaugggaccgugaaagaucgcuccccuuauagaacacugaugagcugucccauuggagaagccccuucucccuacaacucccgguucgagagcguugccugguccgcuucugccugccacgacggcaugggguggcucaccaucggaauuagcggcccugauaauggggcuguggccguccugaaguauaacggaaucauuacagacaccaucaaauccuggcgcaacaagauccuuagaacgcaggagagcgaaugugugugcauuaauggcucuuguuuuacaaucaugaccgauggcccguccaacgggcaggcgagcuacaagauuuucaaaauggagaagggaaaaaucauuaagucuaucgaacuggacgcccccaauuaucauuacgaggagugcagcuguuacccugauacaggcaaaguuaugugcgugugccgggacaacuggcacgcuuccaaucgccccugggucucuuuugaucaaaaccucgacuaucagauuggguacaucuguagcggaguguucggcgauaauccuagauccaacgacgggaagggaaauugcggccccgugcugagcaacggcgccaauggggucaagggauuuucuuuccgguauggcaacgggguuuggaucggacgcaccaaauccauuagcucuagauccggcuuugaaauggugugggacccgaauggguggaccgagacagauagcuccuucucuaugaagcaggacaucauugcucuuacggauuggagcggcuacuccggaucuuuugugcagcacccugaacugaccggcaugaacuguauccggcccugcuucugggucgagcucauucgcgggcaaccuaaagaaagcacaaucuggaccuccggaagcucuaucuccuucuguggcgugaauagcgggacagccucuugguccuggcccgacggagcggaucugcccuuuaccauugacaaguga

SEQ ID NO: 206511 - RNA, 1413 nt, Artificial Sequence; identical to SEQ ID NO: 199477
  derived and/or modified sequence opt5 from neuraminidase__InfluenzaA__AGQ47731

SEQ ID NO: 206512 - RNA, 1377 nt, Artificial Sequence
  derived and/or modified sequence opt5 from neuraminidase__InfluenzaA__AGQ47743
augaaccccaaucagaagaucauuaccaucggcagcauuugcaugguggucgggaucauuucccugauccuccaaaucggaaacauuaucucuauuuggaucagccacuccauucagacaggcaaucagaaccauaaaaauucuacguggaugaaccagaccuacaucaauauuagcaacacaaauguuguggccgggcaagacuccaccucugugauccugacaggaaacagcucccuuuguccuaucagaggcugggcuauuaauagcaaggauaacgggauccggauuggaucuaaaggcgacgucuucgugauccgcgagccguuuauuuccugcagccaccuggaauguagaaccuucuuucucacacagggcgcccugcuuaaugauaagcauucuaacgggaccguuaaagaccggucccccuaucgcgcgcugaugagcugcccugugggagaggcucccucuccuuacaauuccagauucgaaagcgucgccugguccgccucugcuugucacgauggcaugggguggcucacgaucggaaucagcggccccgacaacggggccguggcuguucugaaguauaacggaauuaucaccgagacaauuaaguccuggcggaaaaagauccugcgcacccaggaaagcgagugcacaugugugaauggcucuugcuuuaccauuaugacggauggcccuuccaacgggcucgccagcuacaaaaucuucaagaucgagaaaggaaaggucacaaagucuauugaacugaaugcgccgaacagccauuaugaggaauguuccugcuaccccgacaccggcaaagugaugugugugugcagagauaauuggcacgggucuaaccggccuugggucagcuuugaccagaaucuugauuaucaaaucggauacauuugcuccggcguuuucggggacaacccccgcccuaaggauggaacaggcagcuguggccccgugucugccgacggggcuaauggagugaaaggcuuuuccuacagauaugggaacggagucuggaucggccggaccaagagcaauucuucccgccacggguucgagaugauuugggacccgaacggcuggaccgagacagauagcagauuuuccgugcggcaggacguuguggccaugacggaucgcucuggauacagcggcuccuucguccagcauccugaacugaccgggcucgacugcaugagacccuguuuuuggguggagcugauccggggaagaccugaagaggaaacaauuuggaccucuggcagcaucaucuccuucugcgggguuaauagcgauacaguggacuggucuuggcccgauggagcugagcuucccuucaccauugacaaauga

SEQ ID NO: 206513 - RNA, 1413 nt, Artificial Sequence
  derived and/or modified sequence opt5 from neuraminidase__InfluenzaA__AGQ47755
augaaccccaaucagaagaucauuaccaucggcagcauuugcauggccaucgggacaauuucccugauccuccaaaucggaaacauuaucucuauuuggaucagccacuccauucagacgggcucucagaaucauaccgggaucuguaacagacggauugugacauacgagaauaacaccugggucaaucagacauauguuaacaucagcaauaccaacgugguggcugaaaaagacacaaccuccaugauccuggccggaaauucuagccuuugcccuauucgcggcugggcgaucuacuccaaggauaacagcauuagaaucgggucuaaaggagacgucuucgugauucgggagccguuuaucuccuguagccaccuggaaugccgcacguucuuucucacccaaggcgcucugcuuaaugauaagcauucuaacggcacaguuaaagacagaucccccuaucgggcccugaugagcuguccuaucggggaggcccccucuccuuacaauucccgcuucgaaagcguggcuugguccgccucugcuugccacgauggaaugggcuggcucaccauugggaucagcggacccgacgauggcgccgucgcggugcugaaguauaacgggauuaucacagagauuaucaaguccuggagaaaacagauccugcggacccaggagagcgaauguguuugcgugaacggaucuuguuuuacgauuaugacagacggcccuuccaauggcccggccagcuaccgcaucuucaagauuaaaaaggggaaaaucaccaagucuauugagcucgaugcucccaacagccauuaugaagagugcuccuguuacccugacacaggaaaggucaugugcgugugcagagauaauuggcacggcucuaaccggcccugggugagcuuuaaucagaaccuggacuaccaaaucggguauauuuguuccggagucuucggcgauaauccucgccccaaagacgggaagggaagcugcgacccgguuaacguggauggcgccgacggcgugaaaggguuuucuuacagauauggaaauggcgucuggaucgggcggaccaaguccaccagcucucgcaaaggauucgagaugaucugggauccuaacggcuggacagacacggaugggaauuuucuugugaagcaggacguuguggcuaugaccgauugguccggcuacagcggauccuucguccagcaccccgaacugacaggccucgacuguaugagaccuugcuuuuggguggagcugauucgggggagaccccgcgagaaaaccacaaucuggaccucuggaagcuccauuucuuucuguggcguuaacagcgauacggugaauugguccuggcccgacggggccgaacuuccuuucacaaucgauaaguga

SEQ ID NO: 206514 - RNA, 1410 nt, Artificial Sequence
  derived and/or modified sequence opt5 from neuraminidase__InfluenzaA__AGQ47767
augaaccccaaucagaagaucauuaccaucggcagcauuugcaugguggucgggaucauuucccugauccuccaaaucggaaacauuguuucuaucuggauuagccacuccauccagacaggcaaucagaaccauacggggaccugugaccagucuauuaucacauacaaaaauagcaccugggugaaccaaacauaugugaauauuuccaacaccaaugucguggccggaaaggauacaaccucuguuauccuggcuggcaacagcucccuuugcccuaucagagggugggccauuuacagcaaagacaauggagugcggaucggcucuaagggcgaugucuucgugauucgcgagccguuuaucuccuguagccaccuggaaugcagaacguucuuucucacccagggggcgcugcuuaacgacaaacauucuaauggaacaguuaaggaucggucccccuaucgcgcucugaugagcuguccugugggcgaggcccccucuccuuacaacuccagauucgaaagcgucgccugguccgcuucugccugccacgacgggaugggauggcucaccauuggcaucagcgggcccgaugacggagcuguggccgugcugaaguauaauggcaucauuacagagaccaucaaauccuggcggaaggaaauucugcgcacgcaggagagcgagugugucugcguuaacggcucuuguuuuacaaucaugaccgaugggccuuccggaggcccggcgagcuacaaaauuuucaagaucgaaaaagggaaggugacaaagucuaucgagcucgacgcccccaacagccauuaugaagagugcuccuguuacccugauaccucuaaagugaugugcgucugcagagacaauuggcacggaagcaaccggcccuggguguccuuugaucagaaucuggacuaccaaaugggcuauauuuguagcgggguuuucggagacaacccucgccccaaggauggcaaaggcucuugcgggccgguguacgucgacggagcuaauggcgugaagggguuuuccuauaaauacggaaacggcguuuggaucgggagaaccaagagcaauucuucccggcagggcuucgagaugauuugggauccuaacggauggacagaaacggacagcaacuuuuucaccaaacaggauguggucgccgugacagacugguccggcuauucugggagcuuuguccagcaccccgagcuuaccggacuggauuguaugcgcccuugcuucuggguggaacucaucagaggccggcccaaggagaauacaauuuggaccuccgggucuagcaucuccuucuguggaguuaauagcgacacgguggauuggucuuggcccgacggcgcugaacugccuuuuacaauugauaaguga

SEQ ID NO: 206515 - RNA, 1410 nt, Artificial Sequence; identical to SEQ ID NO: 206496
  derived and/or modified sequence opt5 from neuraminidase__InfluenzaA__AGQ47779

SEQ ID NO: 206516 - RNA, 1413 nt, Artificial Sequence
  derived and/or modified sequence opt5 from neuraminidase__InfluenzaA__AGQ47791
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauaacacaugggucaaucaaacccacguuaacaucagcaauacaaacgugguggcuggaaaagacaccacauccaugauucuggccggcaauucuagccuuugcccuauccgggggugggcgauuuauuccaaggauaacagcauccgcauuggaucuaaaggcgacgucuucgugaucagagaaccguuuaucuccuguagccaucuggagugccggaccuucuuucucacgcagggcgcucugcuuaaugauaagcacucuaacgggaccguuaaagaccgcucccccuacagagcccugaugagcuguccuauuggagaagcccccucuccuuauaauucccgguucgagagcguggcuugguccgccucugcuugccaugauggcaugggguggcucacaaucggaauuagcggccccgacgauggggccgucgcggugcugaaguacaacggaaucauuaccgaaacaaucaaguccuggaaaaagcagauccugcgcacccaggagagcgaguguguuugcgugaacggcucuuguuuuacgauuaugacagacggcccuuccgaugggccggccagcuauagaaucuucaaaauugaaaagggaaaaaucaccaagucuauugagcucgacgcucccaauagccacuacgaagagugcuccuguuauccugauacaggcaccgucaugugcgugugccgggacaacuggcacgggucuaaucgccccugggugagcuuuaaccaaaaucuggauuaccagaucggauacauuuguuccggcgucuucggggacaacccuagacccaaggacggaaaaggcagcugcgauccgguuaauguggacggcgccgauggggugaagggauuuucuuaucgguacggcaacggggucuggaucggacgcaccaaauccaauagcucuagaaagggcuucgagaugaucugggacccuaacggguggacagauacggacggcaauuuucuugugaaacaggauguuguggcuaugaccgacugguccggauauagcggcuccuucguccagcaucccgaacugacagggcucgauuguaugcggccuugcuuuuggguggagcugauucgcggaagaccccgggaaaagaccacaaucuggaccucuggcagcuccauuucuuucugugggguuaacagcgacacggugaauugguccuggcccgauggagccgagcuuccuuucacaaucgacaaauga

SEQ ID NO: 206517 - RNA, 1410 nt, Artificial Sequence
  derived and/or modified sequence opt5 from neuraminidase__InfluenzaA__AGQ47803
augaaccccaaucagaagaucauuaccaucggcagcauuugcaugguggucgggaucauuucccugauccuccaaaucggaaacauuaucucuauuuggaucagccacuccauucagacaggcucucagaaucauacggggaucuguaaccagagcauuaucaccuacaaaaauuccacauggguuaaccaaaccuaugugaauaucucuaacacaaauguggucgccggaaagggcaccacaagcgugauucuggcugggaacuccagccuuugcccuaucagaggaugggccauuuacucuaaagacaauggcauccggauuggcuccaagggggauguuuucgugauccgcgagccguuuaucagcuguucucaccuggaaugcagaaccuucuuucucacgcagggagcgcugcuuaacgacaaacauuccaauggcaccgucaaggaucggagccccuaucgcgcucugaugucuuguccugugggggaggcccccuccccuuacaacagcagauucgaauccguugccuggucugcuugcgccugucacgacggaaugggcuggcucacaauugggaucagcggacccgaugacgaggcuguggccguccugaaguauaauggcauuaucaccgaaacaauuaaauccuggcggaagaaaauccugcgcacccaggagagcgagugcgugugugugaacggcucuugcuuuacgaucaugacagaugggccuuccgacggaccggcgagcuacaagauuuucaaaaucgaaaagggcaaggucaccaaaucuauugagcucgaugcccccaacagccauuaugaagaguguuccugcuacccugacacagggaagguuaugugcguguguagagauaauuggcacggaucuaaccggcccugggugagcuuugaccagaaucuggauuaccaaaucggcuauauuugcuccggggucuucggagacaacccucgccccaaagacggcaagggcagcugugggccgguguacguugauggagcuaauggcgugaaaggguuuucuuauagauacggaaacggcgucuggaucgggcggaccaaguccgacagcucucgccagggcuucgagaugauuugggauccuaauggauggaccgaaacagacuccaacuuuuucgugaaacaggauaucguugccaugacggacuggagcggcuauuccgggucuuuugugcagcaccccgagcuuaccggacuggauugcaugagaccuuguuucugggucgaacucauccggggccgccccaaggagaagacaauuuggaccagcggguccucuaucagcuucugcggagucaauuccgacacaguggauuggagcuggcccgacggcgcugaacugccuuuuaccauugauaaauga

SEQ ID NO: 206518 - RNA, 1368 nt, Artificial Sequence
  derived and/or modified sequence opt5 from neuraminidase__InfluenzaA__AGQ47814
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauaacacaugggucaaagacaccacaagcaugacccuggcuggaaauuccucucuuugcccuauccggggcugggccauuuauagcaaggauaacuccauccgcauugggagcaaaggagacguuuucgugaucagagaaccguuuauuucuuguucccaccuggagugccggacauucuuucucacccaaggcgcgcugcuuaaugauaagcauagcaacggcacggugaaagaccgcucucccuacagagcucugauguccuguccuaucggggaagcccccagcccuuauaauucucgguucgaguccgucgccuggagcgcuuccgccugccacgauggaaugggcuggcucaccaucgggauuucuggacccgacgauggcgcuguggccguucugaaguacaacgggaucauuacagaaaccaucaagagcuggaaaaagcagauucugcgcacacaggaguccgagugugugugcgucaauggaagcuguuuuaccaucaugacggacggcccuucugauggcccggcguccuauagaaucuucaaaauugaaaaggggaaaaucacaaagagcauugagcucgacgcccccaacucucauuacgaagagugcagcuguuauccugauaccggaacagugaugugcguuugccgggacaauuggcacggcuccaaccgccccugggugucuuuuaaccagaaucuggauuaccaaaucggguacauuuguagcggagucuucggcgacaacccuagacccaaggacgggaaaggauccugcgauccggugaauguggacggcgcugauggcgucaagggguuuagcuaucgguacggaaacggcguuuggaucgggcgcaccaaaucuaauuccagcagaaagggauucgagaugauuugggacccuaacggcuggaccgauacagacgggaauuuucuugugaaacaggauguggucgccaugacggacuggucuggcuauuccggcagcuucgugcagcaccccgaacugaccggacucgauuguaugcggccuugcuuuuggguugagcugauccgcgggagaccccgggaaaagacaaccaucuggacauccggaucuagcauuuccuucuguggcgugaacucugacaccgucaauuggagcuggcccgauggggcugagcuuccuuucacgaucgacaaauga

SEQ ID NO: 206519 - RNA, 1413 nt, Artificial Sequence; identical to SEQ ID NO: 199481
  derived and/or modified sequence opt5 from neuraminidase__InfluenzaA__AGQ47826

SEQ ID NO: 206520 - RNA, 1410 nt, Artificial Sequence
  derived and/or modified sequence opt5 from neuraminidase__InfluenzaA__AGQ47838
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucggguaccggaacuggagcaagccccagugcaaaauuacgggauucgcgccuuuuuccaaggauaauucuauccgccugagcgcuggcggggacaucugggugaccagagagcccuauguuuccugugauccuggaaagugcuaccaauucgcccuuggccaggggacaacccuggacaacaaacauucuaaugauacaauucacgaccggaccccgcaucgcacgcuccugaugaacgagcugggagugcccuuucaccucggcacaaagcaggucuguaucgccuggagcuccagcucuugccaugauggcaaggcuuggcugcacguguguguuaccggguaugacaaaaaugccacagcuuccuucauuuacgauggaagacuuguggacagcaucggcucuuggucccagaacauucugcggacccaagaaagcgagugcgucuguaucaaugggaccugcacaguggugaugacggauggaucugccuccggccgcgcggacaccaaaauccucuuuauugaagaggggaagaucguccacauuagcccucuguccggaucugcccagcauguugaggaaugcagcuguuaucccagauacccuggcgugcggugcaucugucgcgauaacuggaagggcuccaauagacccguggucgacauuaacgugaaagacuacagcaucgauucuuccuauguuugcagcgggcuugugggagacacaccgcggaacaaugaucgcucuagcuccucuuacuguagaaacccuaauaacgagaagggcaaucacggggucaaaggaugggcuuucgacgauggcaacgacguguggauggggcggaccaucagcgaagauucccgcagcggauaugagacauuuaagguuauuggcggcuggucuacccccaauuccaaacugcagaucaacagacaggugauugucgacagcgauaaucggucuggguacuccggaaucuucagcguggaaggcaaguccugcauuaacagauguuuuuaugucgagcucauccgcgggcgggagcaagaaacgagagugugguggacaucuaauagcauuguuguguucugcggaaccuccggcaccuacgggacaggcucuuggccugacggagccgauaucaaccugaugcccaucuga

SEQ ID NO: 206521 - RNA, 1362 nt, Artificial Sequence
  derived and/or modified sequence opt5 from neuraminidase__InfluenzaA__AGQ47850
augaaccccaaucagaagaucauuaccaucggcagcauuugcaugguggucgggaucauuucccugauccuccaaaucggaaacauuaucucuauuuggaucagccacuccauucaggccggcucuagcacauggguuaaucagacguacgugaacaucuccaauaccaacguggucgcugggccugacgccacaucugugauucugaccggaaauagcucccuuuguccgaucagaggcugggcgaucuauagcaaagauaacgggauucggaucggaucuaagggcgacauuuucguuauccgcgagcccuuuauuuccugcagccaucuggaauguagagcuuucuuucucacacagggcgcccugcuuaaugauaaacacucuaacgggaccgugaaggaccgguccccuuaccgcgcccugaugagcugccccgucggagaggcuccuucucccuauaauuccagauucgaaagcguggccugguccgcuucugccugucaugauggcaugggguggcucacaaucggaaucagcggcccugacaacggggcgguugccgugcugaaauacaauggaauuaucaccgagacgauuaaguccuggcggaagaaaauccugcgcacccaagaaagcgagugcgcuugugucaacggcucuugcuuuacaauuaugaccgauggcccguccgacgggcccgccagcuauaagaucuucaaaaucgagaagggaaaagugacaaagucuauugaacucgaugcuccuaauagccacuacgaggaauguuccugcuaucccgacaccggcaaggugaugugugucugcagagauaacuggcaugggucuaaccggccuuggguuagcuuugaccagaaucuggauuaccagaucggauacauuugcuccggcguguucggggacagcccccgcccgaaagacggaacgggcucuuguggcccuguguccgucgauggggccaacggagugaagggcuuuagcuauagauacgggaauggaguuuggaucggccggacaaaaucuaaguccagccgccacggguucgagaugauuugggaccccaacggcuggaccgagacagauuccagauuuucugugcggcaggacgucguggcgaugaccgauuggagcggauauuccggcucuuucguucaacacccugaacuuaccgggcuggacugcaugcgccccuguuuuuggguggagcucaucagaggacagcccaaagaaaagacaauuuggacgagcggcuccagcaucucuuucugcggggucaauuccgauaccguggacuggagcuggccugauggagccgagcugccguucacaaucgacaaauga

SEQ ID NO: 206522 - RNA, 1410 nt, Artificial Sequence
  derived and/or modified sequence opt5 from neuraminidase__InfluenzaA__AGQ47873
augaacaccaaucagagaacaaucacgauuggcaccaucugccugauuguggggaucauuagccuccugcuucaaaucggaaacaucauucugcucuggaugucccacucuauccagacaggcgaaaagagccaucccaaagucuguaaucaguccguuauuaccuacgagaacaauacaugggugaaccagaccuaugugaauaucucuaacacaaauauugccgcugggcaaggagucaccccuaucauucuggccggcaacagcucccuuugcccgaucucugggugggcgaucuacagcaaggacaauuccauucggaucggaagcaaaggcgauauuuucgugaugcgcgagcccuuuaucucuuguucccaccuggaaugcagaacguucuuucucacccagggcgcucugcugaacgaccggcauagcaaugggacaguuaaggaucgcucuccuuauagaacccucauguccugucccauuggagaggccccuagccccuacaacucucgguucgaauccguggccuggagcgcuuccgccugccacgacggcaugggguggcugacaaucggaaucucuggcccugauaauggggcugucgccgugcuuaaauauaacggaauuaucaccgacacgauuaagagcuggcgcaacaagauccugagaacacaggaguccgaguguguuugcauuaauggcagcuguuuuaccaucaugacagauggcccgucuaacgggcaggcguccuacaaacucuucaagauggaaaaaggaaagaucauuaaaagcaucgagcuggacgcccccaauuaucauuacgaagagugcucuuguuacccugauaccggcaagguggucugcgugugccgggacaacuggcacgcuagcaaucgccccuggguguccuuugaucaaaaccuugacuaucagauuggguacaucuguucuggagucuucggcgauaauccuagaagcaacgacgggaagggaaauugcggccccguucuguccaacggcgccaauggggugaaaggauuuagcuuccgguauggcaacgggguguggauuggacgcaccaagucuaucuccagcagaucuggcuuugagaugauuugggacccgaauggguggacagaaacggauuccagcuucuccaugaaacaggacaucaucgcucucaccgauuggucuggcuacagcggauccuuuguccagcacccugagcugacaggcaugaacuguauucggcccugcuucuggguggaacugauccgcgggcaaccuaaggagucuaccauuuggacaagcggauccagcaucucuuucuguggcguuaauuccgggaccgccagcuggucuuggcccgacggagcggaucuccccuuuacgauugacaaauga

SEQ ID NO: 206523 - RNA, 1410 nt, Artificial Sequence; identical to SEQ ID NO: 200238
  derived and/or modified sequence opt5 from neuraminidase__InfluenzaA__AGQ47885

SEQ ID NO: 206524 - RNA, 1410 nt, Artificial Sequence; identical to SEQ ID NO: 205004
  derived and/or modified sequence opt5 from neuraminidase__InfluenzaA__AGQ47897

SEQ ID NO: 206525 - RNA, 1410 nt, Artificial Sequence; identical to SEQ ID NO: 197119
  derived and/or modified sequence opt5 from neuraminidase__InfluenzaA__AGQ47909

SEQ ID NO: 206526 - RNA, 1410 nt, Artificial Sequence
  derived and/or modified sequence opt5 from neuraminidase__InfluenzaA__AGQ47921
augaaccccaaucagaagaucauuaccaucggcagcgugucccugacaauugccacggucugcuuccucaugcaaaccgcuauccugguuacaaccgugacacuucacuuuaaacaguacgagugugacucuccugccagcaaccaggugaugccgugcgaacccauuaucaucgagagaaauauuaccgaaaucgucuaucugaacaauacaaccauugagaaggaaaucuguccuaaagugguugaguaccggaacugguccaagccccagugccaaauuacgggguucgcgccuuuuucuaaagauaauagcauccgccucuccgcuggaggcgacauuugggugaccagagagcccuaugucucuugugaucaugggaagugcuaccaguucgcccugggacagggcacaacccuugacaacaagcacagcaaugauacaauccaugaccggaucccucaccgcacccugcucaugaacgaacugggggugccguuucaucugggaacgagacagguuuguauugccugguccuccucuuccugccacgauggcaaggcuuggcuccacguguguaucacaggcgacgauaaaaaugccaccgcuagcuucauuuaugacgggcggcuggucgauucuaucggauccuggagccaaaacauucuucgcacacaggagucugaaugcguguguaucaauggaaccugcaccguggucaugacagacggguccgccagcggcagagcggauacgcggauccuguuuauugaggagggcaaaaucguucauauuagcccccucucugggagcgcccagcacguggaagagugcuccuguuacccucgcuaucccggagugagaugcaucugucgggacaacuggaagggcagcaaucgcccugucguggacauuaacauggaagauuacucuaucgacuccagcuacguuugcucuggccuggugggggauacccccagaaacgacgaucggagcuccaauucuaacugucgcaauccgaacaaugagagaggaaaccagggcgucaaagggugggcuuucgacaauggagaugacguguggaugggccggacaaucagcaaggaucuuagauccggguaugaaaccuuuaagguuauuggaggcuggagcacaccuaacucuaaaucccaaaucaaucgccaggugauugucgacagcgauaaccggucuggcuacuccgggaucuucagcguggagggaaaguccugcauuaauagauguuuuuaugucgagcugauccgcggccggaaacaggaagccagagugugguggaccucuaacagcauuguuguguucugcgggacguccggaacauacggcaccgggucuuggcccgacggcgcuaauaucaacuuuaugccuaucuga

SEQ ID NO: 206527 - RNA, 1365 nt, Artificial Sequence
  derived and/or modified sequence opt5 from neuraminidase__InfluenzaA__AGQ47933
augaaccccaaucagaagaucauuaccaucggcagcauuugcaugguggucgggcugaucucccucauucugcaaaucggaaacaucauuucuaucuggauuagccacuccauccagacaggcucucagaaucauacggggauuuguaaccagaauaucauuaccuacaaaaacagcacauggguuaaggacaccacauccgugauccuuaccggaaauucuagccugugcccuaucagaggcugggccauuuauuccaaagauaacagcauccggauugggucuaagggagacguguucgucauccgcgagccguuuauuuccuguagccaccucgaaugcagaacauucuuucugacccaaggcgcccuucugaaugaucggcauucuaacggcacggugaaagaccgcucccccuacagagcucucaugagcuguccuguuggggaggcgcccucuccuuauaauucccgguucgaaagcguggcuugguccgccucugccugccacgauggaaugggcuggcugaccaucgggaucagcggacccgacaacggcgcugucgccgugcugaaguacaaugggauuaucacagagaccauuaaguccuggcgcaaaaagauccucagaacacaggaaagcgagugugcuugcguuaacggaucuuguuuuaccauuaugacggauggcccuuccgacggccuggccagcuauaaaaucuucaagaucgagaaagggaaggugacaaagucuauugaacuuaaugcgccgaacagccauuacgaggaaugcuccuguuaucccgauaccggaaaagucaugugcgugugccgggacaacuggcacggcucuaaucgcccuugggugagcuuugaucagaaccuggacuaccagaucggguacauuuguuccggagucuucggcgauaaucccagaccuaaggacgggacaggaagcugcggccccguuuauguggacggcgccaacggggugaaaggauuuucuuaccgguauggcaauggggucuggaucggacgcaccaagucccacagcucuagacauggcuucgagaugauuugggauccgaacggguggaccgagacagacuccaaauuuagcgugcggcaagauguuguggcuaugacggacugguccggcuacucuggcagcuucguccagcacccugaacucaccggacuggauuguauccgccccugcuuuuggguggagcuuauuagagggcggccuaaggagaaaacaaucuggaccuccgccucuagcaucuccuucuguggaguuaauagcgacacagugaacuggucuuggcccgauggcgcugaacugcccuucaccauugacaaguga

SEQ ID NO: 206528 - RNA, 1365 nt, Artificial Sequence; identical to SEQ ID NO: 198743
  derived and/or modified sequence opt5 from neuraminidase__InfluenzaA__AGQ47945

SEQ ID NO: 206529 - RNA, 1365 nt, Artificial Sequence; identical to SEQ ID NO: 198743
  derived and/or modified sequence opt5 from neuraminidase__InfluenzaA__AGQ47957

SEQ ID NO: 206530 - RNA, 1365 nt, Artificial Sequence; identical to SEQ ID NO: 198743
  derived and/or modified sequence opt5 from neuraminidase__InfluenzaA__AGQ47969

SEQ ID NO: 206531 - RNA, 1365 nt, Artificial Sequence; identical to SEQ ID NO: 198743
  derived and/or modified sequence opt5 from neuraminidase__InfluenzaA__AGQ47981

SEQ ID NO: 206532 - RNA, 1365 nt, Artificial Sequence
  derived and/or modified sequence opt5 from neuraminidase__InfluenzaA__AGQ48005
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggguuaaggacaccacauccgugauccugaccggaaauucuagccucugcccuaucagaggcugggccauuuauuccaaagauaacagcauccggauugggucuaagggagacguguucgucauccgcgagccguuuauuuccuguagccaccuggaaugcagaacauucuuucuuacccaaggcgcucugcucaaugauaaacauucuuccggcacggugaaggaccggagccccuaccgcgcccugaugucuuguccuguuggggaggcgcccuccccuuauaacagcagauucgaauccguggcuuggucugccagcgccugccacgauggaaugggcuggcugaccaucgggaucuccggacccgacaauggcgcugucgccgugcucaaguacaacgggauuaucacagagaccauuaaaagcuggcggaagaaaauccugcgcacacaggaaucugagugugcuugcguuaauggauccuguuuuaccauuaugacggauggcccuagcgacggccuugccucuuauaagaucuucaaaaucgagaaggggaaggugacaaaaagcauugaacugaacgcgcccaauucccauuacgaggaaugcucuuguuauccggauaccggaaaggucaugugcgugugcagagacaacuggcacggcagcaaccggccuuggguguccuuugaucagaaucucgacuaccagaucggguacauuuguagcggagucuucggcgauaacccccgcccugaggacgggacaggaucuugcggccccguuuauguggacggcgccaauggggugaaaggauuuuccuacagauauagcaacggcgucuggaucgggcggaccaagucucacuccagccgccauggauucgagaugauuugggauccgaauggcuggaccgaaacagacuccaaauuuucugugagacaagauguuguggcuaugacggacuggagcggguacuccggcucuuucguccagcacccugagcugaccggacuugauuguaugcggcccugcuuuuggguggaacugauccgcggcagaccuaaggagaaaacaauuuggaccagcgccuccagcaucucuuucugugggguuaacuccgacacaguggauuggagcuggcccgacggagcugaacuccccuucucuaucgauaaguga

SEQ ID NO: 206533 - RNA, 1365 nt, Artificial Sequence; identical to SEQ ID NO: 206532
  derived and/or modified sequence opt5 from neuraminidase__InfluenzaA__AGQ48017

SEQ ID NO: 206534 - RNA, 1365 nt, Artificial Sequence; identical to SEQ ID NO: 198743
  derived and/or modified sequence opt5 from neuraminidase__InfluenzaA__AGQ48029

SEQ ID NO: 206535 - RNA, 1365 nt, Artificial Sequence
  derived and/or modified sequence opt5 from neuraminidase__InfluenzaA__AGQ48041
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggaucaaggacaccacauccguuauccugaccggaaauucuagccucugcccuauuagaggcugggccaucuauuccaaagauaacagcauucggaucgggucuaagggagacguguucgugauucgcgagccguuuaucuccuguagccaccuggaaugcagaacauucuuucuuacccaaggcgcucugcucaaugauaaacauucuuccggcacggucaaggaccggagccccuaccgcgcccugaugucuuguccugugggggaggcgcccuccccuuauaacagcagauucgaauccguugcuuggucugccagcgccugccacgauggaaugggcuggcugaccaucgggauuuccggacccgacaauggcgcuguggccguccucaaguacaacgggaucauuacagagaccaucaaaagcuggcggaagaaaauucugcgcacacaggaaucugagugugcuugcgugaauggauccuguuuuaccaucaugacggauggcccuagcgacggccuugccucuuauaagaucuucaaaauugagaaggggaagguuacaaaaagcaucgaacugaacgcgcccaauucccauuacgaggaaugcucuuguuauccggauaccggaaaggugaugugcgucugcagagacaacuggcacggcagcaaccggccuuggguguccuuugaucagaaucucgacuaccagauuggguacaucuguagcggaguguucggcgauaacccccgcccugaggacgggacaggaucuugcggccccgucuauguugacggcgccaauggggugaaaggauuuuccuacagauauggcaacgggguguggauuggacggaccaagagccacucuucccgccauggcuucgagaugaucugggauccgaauggguggaccgaaacagacagcaaauuuuccgucagacaagaugugguugcuaugacggacuggucuggcuacagcggauccuucgugcagcacccugagcugaccggccuugauuguaugcggcccugcuuuugggucgaacugauucgcgggagaccuaaggagaaaacaaucuggaccucugccagcuccaucagcuucuguggagugaacucugacacaguugauugguccuggcccgacggcgcugaacuccccuucagcauugauaaguga

SEQ ID NO: 206536 - RNA, 1365 nt, Artificial Sequence
  derived and/or modified sequence opt5 from neuraminidase__InfluenzaA__AGQ48053
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggaucaaggacaccacauccguuauccugaccggaaauucuagccucugcccuauuagaggcugggccaucuauuccaaagauaacagcauucggaucgggucuaagggagacguguucgugauucgcgagccguuuaucuccuguagccaccuggaaugcagaacauucuuucuuacccaaggcgcucugcucaaugauaaacauucuuccggcacggucaaggaccggagccccuaccgcgcccugaugucuuguccugugggggaggcgcccuccccuuauaacagcagauucgaauccguugcuuggucugccagcgccugccacgauggaaugggcuggcugaccaucgggauuuccggacccgacaauggcgcuguggccguccucaaguacaacgggaucauuacagagaccaucaaaagcuggcggaagaaaauucugcgcacacaggaaucugagugugcuugcgugaauggauccuguuuuaccaucaugacggauggcccuagcgacggccuugccucuuauaagaucuucaaaauugagaaggggaagguuacaaaaagcaucgaacugaacgcgcccaauucccauuacgaggaaugcucuuguuauccggauaccggaaaggugaugugcgucugcagagacaacuggcacggcagcaaccggccuuggguguccuuugaucagaaucucgacuaccagauuggguacaucuguagcggaguguucggcgauaacccccgcccugaggacgggacaggaucuugcggccccgucuauguugacggcgccaauggggugaaaggauuuuccuacagauauggcaacgggguguggauuggacggaccaagagccacucuucccgccauggcuucgagaugaucugggauccgaauggguggaccgaaacagacagcaaauuuuccgucagacaagaugugguugcuauggccgacuggucuggcuacagcggauccuucgugcagcacccugagcugacgggccuugauuguaugcggcccugcuuuugggucgaacugauucgcgggagaccuaaggagaaaaccaucuggacaucugcuagcuccaucagcuucuguggagugaacucugacaccguugauugguccuggcccgacggcgccgaacuccccuucagcauugauaaguga

SEQ ID NO: 206537 - RNA, 1410 nt, Artificial Sequence
  derived and/or modified sequence opt5 from neuraminidase__InfluenzaA__AGQ81707
augaaccccaaucagaagaucauuaccaucggcagcauuugcauggugaucgggauugccucccugaugcuccaaaucggaaacaugaucucuauuugggucagccacuccauccagacaggcaaucaguaccagccugagccguguaaccaaucuauuaucacguaugaaaauaacaccuggguuaaucagacauacgugaacauuagcaauaccaacuuccugacagagcaggcugugaccuccgucgcccuugcgggaaauucuagccugugccccaucuccgggugggcuauuuauagcaaagacaacggcaucagaaucgggucuaagggagauguguuuguuauucgggaaccuuucaucuccuguagccaucucgagugccgcacauuuuuccugacccagggcgcccuucugaaugacaaacacucuaacggcacggugaaggauagaucccccuaccggacccucaugagcuguccugucggggaagcccccucuccuuauaauucccgcuuugagagcguggcuugguccgccucugcuugccaugacggaauuagcuggcugacaaucggcauuuccgggccggauaacggagccguugcggugcugaaauacaacggcaucaucaccgacacaauuaagagcuggagaaauaacauccuccggacccaagagucugaaugugccugcgucaauggguccuguuucacggugaugacagauggacccagcaacggccaggcuucuuauaagauuuuuaaaaucgagaagggcaaaguggucaagagcguugaacugaaugccccuaacuaccacuacgaggagugcuccuguuaucccgacgcugggaaaauuaugugcgugugccgcgauaauuggcauggaucuaacagaccuugggugagcuucaaucagaaccuugaauaccagaucggcuauaucuguuccggggucuuuggagacaauccccggccgaacgauggcaccgggagcugcggaccugugucuuccaauggcgccuacggcguuaagggguucagcuuuaaguauggaaacggcguguggauugggcgcacaaaaucuaccuccagcagauccggauucgagaugaucugggaccccaauggcuggaccgaaacagauucuagcuuuuccgucaagcaagacauuguggcgaucacggacuggucuggguacagcggcuccuucguucagcacccugagcugaccggacucgauuguaugcggcccugcuucuggguggaacugauucgcggcagacccaaagagaacacaaucuggaccagcgggucuuccauuagcuuuuguggagucgacucugauacagugggcugguccuggccugacggggccgagcuuccguucaccaucgauaaguga

SEQ ID NO: 206538 - RNA, 1410 nt, Artificial Sequence
  derived and/or modified sequence opt5 from neuraminidase__InfluenzaA__AGQ81715
augaaccccaaucagaagaucauugccaucggcagcgugucccugaccauugcuacaaucugccuccugaugcaaauugccauccuugucacgaccaugacacugcacuucaaacauaacgaguguaccaauucuagcaacaaucaggcgguuccuugcgggccgaucauuaucgaaagaaacgugacagagauugugcaccucaauuccaccacacuggaaaaggagaucugucccaaagcugccggauaccgggacuggucuaagccucagugccagauuaccggcuuugcccccuucagcaaagauaacuccauccgccuuucugcuagcggggacauuugggucacgagagaaccuuauguguccuguggacugggcaagugcuaccaauuugcccucgggcagggaaccacacuggauaaucggcauagcaacggcaccucucacgaccgcacacccuauagaacccugcucaugaaugagcugggcguuccuuuccaucuugcuacgaaacagguguguaucgccugguccucuagcuccugccacgaugggaaggcguggcugcacgucugugugacaggagacgaucggaacgccaccgcuagcaucauuuacgacggcauccucguugauucuauuggguccuggagcaagaauauccugcgcacacaggaguccgaaugcguguguauuaacggaaccugcaccgucgugaugacagacggcucugccagcgggaaagcugauacgagaauccuuuuuauccgggagggaaagauugugcauaucuccccgcugagcggcucugcccaacacgucgaagagugcuccuguuauccccaguacccugagguucgcugcguguguagagacaauuggcggggcagcaaccgccccgugcucuauauuaacauggcggauuacucuaucgacagcggguacgucugcuccggacuggugggcgacaccccuagaaaugaugacauuucuagcuccagcaacuguaaagaucccaauaacgaacgcggggccccgggaguuaagggcugggcuuucgacucugggaaugauaucuggaugggacggacaaucgagaaggacuccagaagcggcuaugaaaccuuucgggugauuggcggguggaacacagccaauucuaaaucccagaccagcagacaggucaucguggauuccggaaacucuagcggcuacuccgggauuuucucuaucgagggaaagagcugcauuaaucgcuguuuuuauguugaacugauccggggcagaccuaaagagacgcgcgugugguggacauccaacagcauuaucgucuucugcgggaccucuggcaccuacggaacaggcuccuggcccgacggggcuaauaucaacuuuauggccauuuga

SEQ ID NO: 206539 - RNA, 1410 nt, Artificial Sequence
  derived and/or modified sequence opt5 from neuraminidase__InfluenzaA__AGQ81717
augaaccccaaucagaagaucauugccaucggcagcgugucccugaccauugcuacaaucugccuccugaugcaaauugccauccuugucacgaccaugacaccucacuucaaacaugacgaguguaccaacucuagcaauaaccaggcgguuccgugcgggcccaucauuaucgaaagaaaugugacagagauugugcacaucaacuccaccauucuggaaaaggagaucuguccuaaagcugccggauaccggaauuggucuaagccccagugccagauuaucggcuuugccccuuucagcaaagauaacuccauccgccucucugcuagcggggacauuugggucacaagagaacccuauguguccuguggacugggcaagugcuaccaauuugcccuugggcagggaaccacgcuggauaaucggcauagcaacggcaccucucacgaccgcacaccucauagaacccuccugaugaaugagcugggcguuccguuccaccucgcuacaaaacagguguguaucgccugguccuccucuuccugccacgaugggaaggcguggcugcaugucugugugaccggagacgaucggaacgccacggcuagcauuaucuaugacggcaugcuuguugauucuauuggguccuggagcaagaauauccugcgcacacaggaguccgaaugcguguguaucaacggaaccugcacagucgugaugaccgacggcucugccagcgggaaagcugauacccggauucucuuuauccgggagggaaagauugugcacaucagcccccugagcggcucugcccaacaugucgaagagugcuccuguuacccucaguaucccgagguucgcugcguguguagagacaauuggcggggcagcaaccgcccugugcuuuacauuaacauggcggauuauucuaucgacagcggguacgucugcuccggacuggugggcgacacacccagaaaugaugacaucucuagcuccagcaacuguaaagauccgaauaacgaaagaggggccccuggaguuaagggcugggcuuucgacucugggaaugauauuuggaugggacgcacgaucgagaaggacuccagaagcggcuacgaaaccuuucgggugauuggcggguggaacacagccaauucuaaaucccagaccagcagacaggucaucguggauuccgacaacucuagcggauauuccggcauuuucucuguugagggaaagagcugcaucaaucgcuguuuuuacguggaacucauucgggggagacccaaagagacacgcgucugguggaccuccaacagcaucaucguguucugcggcacgucugggacauauggcaccggauccuggccugauggcgcuaauauuaacuuuauggccaucuga

SEQ ID NO: 206540 - RNA, 1410 nt, Artificial Sequence
  derived and/or modified sequence opt5 from neuraminidase__InfluenzaA__AGQ81718
augaaccccaaucagaagaucauugccaucggcagcgugucccugaccauugcuacaaucugccuccugaugcaaauugccauccuugucacgaccaugacacugcacuucaaacauaacgaguguaccaauucuagcaacaaucaggcgguuccuugcgggccgaucauuaucgaaagaaaccucacagagauugugcaccugaauagcaccauccuugaaaaggagauuugucccaaagcugccggauaccggaacuggucuaagccucagugccagaucacaggcuuugcccccuucagcaaagacaauuccauucgccugucugcuagcggggauaucugggugaccagagaaccuuaugucuccuguggacucggcaagugcuaccaauuugcccuggggcagggaacgacccuggacaaccggcauagcaauggcacaucucacgaucgcacaccccauagaacccuccugaugaacgagcuuggcgugccuuuccaccuguccaccaagcagguuuguaucgcuugguccucuuccagcugccacgacgggaaagccuggcuccaugugugugucacgggagaugaccggaaugcgacagccucuauuaucuaugauggcauucugguggacuccaucguuagcugguccaagaacauucuucgcacccaggagucugaaugcguguguaucaaugggacaugcaccgucgugaugaccgauggaagcgcuuccggcaaagccgacacaagaauccuguuuauucgggaggggaagaucgugcacauuagcccgcucucuggauccgcucaacaugucgaagagugcagcuguuacccccgcuauccugagguuagaugcgugugucgggauaacuggcgcggcucuaacagacccgugcuguacaucaauauggccgacuauagcauugauuccggcuacgucugcucugggcuggugggagacacgccucggaacgacgauaccagcuccagcucuaauugucgcgaccccaacaaugaaagaggcgcgccggggguuaaaggaugggccuucgauuccggcaacgacaucuggauggggcggacaaucgagaaggauagcagaucuggauacgaaaccuuucgcgugauuggcggcuggaauacagcuaacuccaagagccagaccucccggcaggucaucguggacucugauaauagcuccggguauucuggaguuuucagcguggagggcaaauccugcauuaacagauguuuuuacgucgaacucauccgcgggcggccuaaggagacgagagugugguggacaagcaauucuauuaucgucuucugcggaaccuccggcaccuaugggacaggcagcuggcccgacggagccaacauuaauuuuauggcuaucuga

SEQ ID NO: 206541 - RNA, 1410 nt, Artificial Sequence
  derived and/or modified sequence opt5 from neuraminidase__InfluenzaA__AGQ81719
augaaccccaaucagaagaucauugccaucggcagcgugucccugaccauugcuacaaucugccuccugaugcaaauugccauccuugucacgaccaugacacugcacuucaaacauaacgaguguaccaauucuagcaacaaucaggcgguuccuugcgggccgaucauuaucgaaagaaacgugacagagauugugcaccucaauuccaccacacuggaaaaggagaucuguaccaaagcugccggauaccgggacuggucuaagccccagugccagauuacgggcuuugccccuuucagcaaagauaacuccauccgccuuucugcuagcggggacauuugggucaccagagaacccuauguguccuguggacugggcaagugcuaccaauuugcccucgggcagggaacaacccuggauaaucggcauagcaacggcacaacccacgaccgcacgccucauagaacacugcucaugaaugagcugggcguucccuuccaccuugcuaccaaacagguguguaucgccuggucuuccagcucuugccacgaugggaaggcguggcugcaugucugugugacaggagacgaucggaacgccaccgcuuccaucauuuaugacggcauccucguugauagcauugggucuugguccaagaauauccugcgcacccaggagagcgaaugcguguguauuaacggaacaugcacggucgugaugaccgacggcuccgccucugggaaagcugauacaagaauccuuuuuauccgggagggaaagauugugcacaucagcccucuguccggcagcgcccaacaugucgaagagugcucuuguuacccgcaguaucccgagguucgcugcguguguagagacaauuggcggggcuccaaccgcccugugcucuacauuaacauggcggauuauagcaucgacucuggguacgucugcagcggacuggugggcgacacccccagaaaugaugacauuuccucuaacagcaauuguaaagauccuaacaaugaauccggggcccccggaguuaagggcugggcuuucgacagcgggaacgauaucuggaugggacggacaaucgagaaggacucucgcuccggcuacgaaaccuuuagagugauuggcggguggaauacggccaacagcaaaucucagacaucccggcaggucaucguggauagcgacaauuccucuggauauagcggcauuuucuccaucgaggggaagucuugcauuaacagauguuuuuacguugaacugauccgcggacggccgaaagagaccagagugugguggaccagcaauuccauuaucgucuucugcggcacaagcgggaccuauggcacaggaucuuggccugauggcgcuaacaucaauuuuauggccauuuga

SEQ ID NO: 206542 - RNA, 1410 nt, Artificial Sequence
  derived and/or modified sequence opt5 from neuraminidase__InfluenzaA__AGQ81722
augaaccccaaucagaagaucauugccaucggcagcgugucccugaccauugcuacaaucugccuccugaugcaaauugccauccuugucacgaccaugacaccucacuucaaacaugacgaguguaccaacucuagcaauaaccaggcgguuccgugcgggcccaucauuaucgaaagaaaugugacagagauugugcacaucaacuccaccauucuggaaaagggaaucuguccuaaagcugccggcuaccggaauuggucuaagccccagugccagauuaucggguuugccccuuucagcaaagauaacuccauccgccucucugcuagcggagacauuugggucacaagagagcccuauguguccuguggccuggggaagugcuaccaauuugcccuuggacagggcaccacgcuggauaaucggcauagcaacggcaccucucacgaccgcacaccucauagaacccuccugaugaaugaacuggggguuccguuccaccucgcuacaaaacagguguguaucgccugguccuccucuuccugccacgauggaaaggcguggcugcaugucugugugaccggcgacgaucggaacgccacggcuagcauuaucuaugacgggaugcuuguugauucuauuggauccuggagcaagaauauccugcgcacacaggaguccgagugcguguguaucaacgggaccugcacagucgugaugaccgacggcucugccagcggaaaagcugauacccggauucucuuuaucagagaaggcaagauugugcacaucagcccccugagcggcucugcccaacaugucgaggaaugcuccuguuacccucaguaucccgagguucgcugcguguguagagacaauuggcgggggagcaaccgcccugugcuuuacauuaacauggcggauuauucuaucgacagcggauacgucugcuccggccuggugggggacacacccagaaaugaugacacgucuagcuccagcaacuguaaagauccgaauaacgagcggggagccccuggcguuaaggggugggcuuucgacucuggaaaugauaucuggaugggccgcaccauugaaaaggacuccagaagcggcuacgagacauuucgggugaucgggggauggaacaccgccaauucuaaaucccagacaagcagacaggucauuguggauuccgacaacucuagcggcuauuccgggaucuucucuguugaaggaaagagcugcauuaaucgcuguuuuuacguggagcucauccggggcagacccaaagaaacccgcgucugguggacguccaacagcauuaucguguucugcgggacaucuggcaccuauggaaccggcuccuggccugauggggcuaauaucaacuuuauggccauuuga

SEQ ID NO: 206543 - RNA, 1410 nt, Artificial Sequence
  derived and/or modified sequence opt5 from neuraminidase__InfluenzaA__AGQ81724
augaaccccaaucagaagaucauugccaucggcagcgugucccugaccauugcuacaaucugccuccugaugcaaauugccauccuugucacgaccaugacacugcacuucaaacauaacgaguguucuaauagcuccaacaaucaggcgguuccuugcgggccgaucauuaucgaaagaaacgugaccgagauugugcaccucaauucuacaacccuggaaaaggagaucugucccaaagcugccggauaccgggacuggagcaagccucagugccagauuacaggcuuugcccccuucuccaaagauaacucuauccgccuuagcgcuuccggggacauuugggucaccagagaaccuuaugugagcuguggacugggcaagugcuaccaauuugcccucgggcagggaacgacccuggauaaucggcauucuaacggcacaucccacgaccgcacaccccauagaacccugcucaugaaugagcugggcguuccuuuccaccuugcuaccaaacagguguguaucgccuggucuagcuccagcugccacgaugggaaggcguggcugcaugucugugugacgggagacgaucggaacgccacagcuucuaucauuuaugacggcauccucguugauuccauugggagcugguccaagaauauccugcgcacccaggagucugaaugcguguguauuaacggaacaugcaccgucgugaugaccgacggcagcgccuccgggaaagcugauacaagaauccuuuuuauccgggagggaaagauugugcacaucagcccgcugucuggcuccgcccaacaugucgaagagugcagcuguuacccccaguauccugagguucgcugcguguguagagacaauuggcggggcucuaaccgccccgugcucuacauuaacauggaagauuauagcaucgacuccggguacgucugcucuggacuggugggcgacacgccuagaaaugaugacauuagcuccagcucuaacuguaaagaucccaauaacgagcgcggggcgccgggaguuaagggcugggccuucgacuccgggaaugaucuguggaugggacggaccaucgaaaaggacagcagaucuggcuacgagacauuucgggugaucggcggguggaacaccgcuaauuccaaaagccagacauccagacaggucauuguggauucugacaacagcuccggauauucuggcaucuucagcguugaagggaaguccugcauuaaucgcuguuuuuacguggagcucauccggggaagaccuaaagagacccgcgucugguggacgagcaacucuauuaucguguucugcggcacauccgggaccuauggcaccggaagcuggcccgauggcgccaauauuaacuuuauggcuaucuga

SEQ ID NO: 206544 - RNA, 1410 nt, Artificial Sequence
  derived and/or modified sequence opt5 from neuraminidase__InfluenzaA__AGQ81726
augaaccccaaucagaagaucauugccaucggcagcgugucccugaccauugcuacaaucugccuccugaugcaaauugccauccuugucacgaccaugacacugcacuucaaacauaacgaguguucuaauagcuccaacaaucaggcgguuccuugcgggccgaucauuaucgaaagaaacauuaccgagaucgugcaccucaauucuacaacccuggaaaaggagauuugucccaaagcugccggauaccgggacuggagcaagccucagugccagaucacaggcuuugcccccuucuccaaagauaacucuauucgccuuagcgcuuccggggacaucugggugaccagagaaccuuaugucagcuguggacugggcaagugcuaccaauuugcccucgggcagggaacgacccuggauaaucggcauucuaacggcacaucccacgaccgcacaccccauagaacccugcucaugaaugagcugggcgugccuuuccaccuugcuaccaagcagguuuguaucgccuggucuagcuccagcugccacgaugggaaagcguggcugcaugugugugucacgggagacgaucggaacgccacagcuucuauuaucuaugacggcauucucguggauuccaucgggagcugguccaagaauauucugcgcacccaggagucugaaugcguuuguaucaaaagaacaugcaccguggucaugaccgacggaagcgccuccggcaaggcugauacacggauccuuuuuauucgcgaggggaaaaucgugcacauuagcccgcugucuggauccgcccaacauguggaagagugcagcuguuacccccaguauccugaggucagaugcguuugucgggacaacuggcgcggcucuaauagacccgugcucuacaucaacauggcggauuauagcauugacuccggcuacgugugcucugggcuggucggagacacgccucggaacgaugacaucagcuccagcucuaauuguaaggaucccaacaaugaacgcggcgccccgggggugaagggaugggcuuucgacuccggcaacgaucuguggauggggagaaccaucgagaaagaaagccggucuggauacgagacauuuagaguuauuggcggcuggaauaccgccaacuccaagagccagacaucccgccaggugaucgucgacucugauaauagcuccggguauucuggaauuuucagcguggaaggcaaauccugcaucaaccgguguuuuuacguugagcucauuagagggcgcccuaaggagacccgggugugguggacgagcaauucuaucauugucuucugcggaacauccggcaccuaugggaccggcagcuggcccgacggagcuaacaucaauuuuauggccaucuga

SEQ ID NO: 206545 - RNA, 1410 nt, Artificial Sequence
  derived and/or modified sequence opt5 from neuraminidase__InfluenzaA__AGQ81727
augaaccccaaucagaagaucauugccaucggcagcgugucccugaccauugcuacaaucugccuccugaugcaagucgccauucuuguuacgaccaugacacugcacuucaaacauaacgaguguucuaauagcuccaacaaucaggcggugccuugcgggccgaucaucauugaaagaaacaucaccgagauugugcaccucaauucuacaacccuggaaaaggagaucugucccaaagcugccggauaccgggacuggagcaagccucagugccagauuacaggcuuugcccccuucuccaaagauaacucuauccgccuuagcgcuuccggggacauuugggucaccagagaaccuuaugugagcuguggacugggcaagugcuaccaauuugcccucgggcagggaacgacccuggauaaucggcauucuaacggcacaucccacgaccgcacaccccauagaacccugcucaugaaugagcugggcguuccuuuccaccuugcuaccaaacagguguguaucgccuggucuagcuccagcugccacgaugggcgggcguggcugcaugucugugugacgggagacgaucgcaacgccacagcuucuaucauuuaugacggcauccucguugauuccauugggagcugguccaagaauauccugagaacccaggagucugaaugcguguguauuaacggaacaugcaccgucgugaugaccgacggcagcgccuccgggaaggcugauacacggauccuuuuuauccgcgagggaaaaauugugcacaucagcccgcugucuggcuccgcccaacaugucgaagagugcagcuguuacccccaguauccugagguuagaugcgugugucgggacaauuggcgcggcucuaacagacccgugcucuacauuaacauggcggauuauagcaucgacuccggguacgucugcucuggacuggugggcgacacgccucggaaugaugacauuagcuccagcucuaacuguaaggaucccaauaacgaacgcggggccccgggaguuaaaggcugggcuuucgacuccgggaaugaucuguggaugggaagaaccaucgagaaggaaagccggucuggcuacgagacauuuagagugaucggcggguggaacaccgccaauuccaagagccagacaucccgccaggucauuguggacucugauaacagcuccggauauucuggcaucuucagcguugaagggaaauccugcauuaaucgguguuuuuacguggagcucaucagaggacgcccuaaggagacccgggucugguggacgagcaacucuauuaucguguucugcggcacauccgggaccuauggcaccggaagcuggcccgacggcgcuaauauuaacuuuaugccuaucuga

SEQ ID NO: 206546 - RNA, 1410 nt, Artificial Sequence
  derived and/or modified sequence opt5 from neuraminidase__InfluenzaA__AGQ81728
augaaccccaaucagaagaucguggccauuggcagcgucucccugaccaucgcuacaaugugccuccugaugcaaauugcccuuuucgcgacgaccaugacacugcacuuuaaacagaccgggucuacaaacagcuccgacaaucaggcuguuccuuguggaccgaucauuaucgagagaaacaucaccgaaauugugcaucucaauucuacaacccuggagaaggaaacgugccccaaaagcgccggcuaccggaacugguccaagccucagugucaaaucaccggguucgcccccuuuucuaaagauaauagcauucgccuuuccgcuggaggcgacaucugggugacaagagagccuuaugucagcugcgggcugggaaaguguuaccaguucgcccucggccagggcaccacacuggauaacaagcacucuaaugggaccacguaugaccggacaccccaucgcacccugcucaugaacgaacugggagugccuuuucaccuugcuacaaaacagguuugcauugccugguccucuagcuccugucaugauggcaaggcguggcugcacgugugcgucaccggggacgauaaaaaugccaccgcuagcaucauuuacgacggaauccucguggauucuaucgccuccuggagcaagaacauucugagaacacaagaguccgaguguguuugcaucaauggcacguguaccguggucaugacagacgggucugcuagcggacgggccgauacccgcauucuuuucaucagagaaggcaaaauugugcacaucuccccgcugagcggcucugcgcagcauguggaggaaugcuccugcuauccccgguacccugagguccgcuguguuugcagagacaacuggaaggggagcaaucggcccgugcucuauaucaacauggccgauuacucuauugacagcuccuacguguguucuggaaucgucggcgacacaccucgcaacgaugacagaagcuccagcucuaauugccgggaucccaacaaugagauuggggcuccgggagugaagggcugggccuuugacuccgggaacgauaucuggaugggacgcaccauugaaaaagacagcagaucuggcuaugagacguuccggguuaucggcgggugguccacagcuaauagcaagucccagaucaacagacaggugauugucgaucgcgacaauucuagcggauacuccggcaucuuuucuguggaagggaaaagcuguauuaaccggugcuucuauguugagcugaucagaggacgcccuaaggaaaaucgggugugguggaccuccaacagcauuaucgucuuuuguggcaccucugggacauacggcaccggauccuggcccgauggcgccaauauuaaccugaugccuaucuga

SEQ ID NO: 206547 - RNA, 1410 nt, Artificial Sequence
  derived and/or modified sequence opt5 from neuraminidase__InfluenzaA__AGQ81729
augaaccccaaucagaagaucauugccaucggcagcgugucccugaccauugcuacaaucugccuccugaugcaaauugccauccuugucgcgacgaugacccugcacucuaaacauggggaguguacaaacagcuccaauaaccaggcuguuccuugcggaccgaucauuaucgaaagaaaugugaccgagauugugcaccucaacucuacaacccuggaaaaggagaucugucccaaagccgccggcuaccgggacuggagcaagccucagugccagauuacaggguucgcucccuuuuccaaagauaauucuauccgccuuagcgccuccggagacauuugggucaccagagaaccuuaugugagcuguggccuggggaagugcuaccaauucgcucucggacagggcacgacccuggauaaccggcauucuaauggcacaucccacgaccgcacaccccauagaacccugcucaugaacgagcuggggaucccuuuucaccuugccaccaagcagguuuguaucgcguggucuucuuccagcugccacgauggaaaagccuggcugcaugugugugucacgggcgacgaucggaaugcuacagccucuauuaucuaugacgggaugcucguggauuccauuggaagcugguccaagaacauccugcgcacccaggagucugaaugcguuuguauuaauggcacaugcaccguggucaugaccgacgggagcgcuuccggaaaagccgauacaagaauccuuuucauccgggagggcaagauugugcacaucagcccgcugcucggcucugcgcaacauguggaagagugcuccuguuacccccaguauccugagguccgcugcguuuguagagacaacuggcgggggagcaaucgccccgugcuguacauuaacauggccgauuauucuguggacagcggauacgucugcuccggccuggugggggacacgccuagaaacgaugacaccucuagcuccagcaauuguaaagaucccaacaaugaacggggagcuccgggcguuaaggggugggccuuugacucuggaaacgauaucuggaugggccgcacaauugagaaggacuccagaagcggcuacgaaaccuuccgggugaucgggggauggaauacagcuaacucuaaaucccagaccagcagacaggucaucguggauuccgacaauucuagcggcuauuccgggauuuuuagcguugagggaaagagcugcaucaaccgcuguuucuacguggaacucauucggggcagaccuaaagagacgcgcgucugguggacauccaauagcaucauuguguuuugcgggaccucuggcaccuauggaacaggcuccuggcccgauggggccaacaucaauuucaugccuauuuga

SEQ ID NO: 206548 - RNA, 1410 nt, Artificial Sequence
  derived and/or modified sequence opt5 from neuraminidase__InfluenzaA__AGQ81730
augaaccccaaucagaagaucauugccaucggcagcgugucccugaccauugcuacaaucugccuccugaugcaaauugccauccuugucacgaccaugacacugcacuucaaacauaacgaguguaucaauucuagcaacaaucaguccguuccuugcgggccgauuaucauugaaagaaacgugaccgagaucgugcaccucaauucuacaacccuggaaaaggagauuugucccaaagcggcuggauaccgggacuggagcaagccucagugccagaucacaggcuuugcccccuucuccaaagauaacucuauucgccuuagcgccuccggggacaucugggucaccagagaaccuuaugugagcuguggacugggcaagugcuaccaauuugcucucgggcagggaacgacccuggauaaucggcauucuaacggcacaucccacgaccgcacaccccauagaacccugcucaugaaugagcugggcguuccuuuccaccuugccagcaaacagguguguaucgcuuggucuuccagcucuugccacgaugggaaggccuggcugcaugucugugugaccggagacgaucggaacgcgacggccuccauuaucuaugacggcaugcucguugauagcauuggguccuggucuaagaauauccugcgcacacaggagagcgaaugcguguguauuaacggaaccugcacagucgugaugaccgacggcuccgcuagcggggaggccgauaccagaauccuuuuuauccgggaaggaaaaauugugcacaucucuccgcuguccggcagcgcucaacaugucgaggagugcucuuguuacccccaguauccugaaguucgcugcguguguagagacaauuggcggggcagcaaccgccccgugcucuacauuaacauggccgauuauuccaucgacucuggguacgucugcagcggacuggugggcgacacaccuagaaaugaugacauuuccucuagcuccaacuguaaggaucccaauaacgagcgcggggcgccgggaguuaaaggcugggccuucgacagcgggaaugauaucuggaugggacggacgaucgaaaaggacucuagauccggcuacgagaccuuucgggugauuggcggguggaacacagcuaauagcaagucccagaccucuagacaggucaucguggauagcgacaacuccucuggauauagcggcauuuucuccguugaagggaaaagcugcaucaaucgcuguuuuuacguggagcugauucggggaagaccuaaggagacacgcgucugguggaccucuaacuccaucauuguguucugcggcacgagcgggacauauggcaccggaucuuggcccgauggcgccaauaucaacuuuauggcuaucuga

SEQ ID NO: 206549 - RNA, 1410 nt, Artificial Sequence
  derived and/or modified sequence opt5 from neuraminidase__InfluenzaA__AGQ81731
augaaccccaaucagaagaucauugccaucggcagcgugucccugaccauugcuacaaucugccuccugaugcaaauugccauccuugucacgaccaugacacugcacuucaaacauaacgaguguucuaauagcuccaacaaucaggcgguuccuugcgggccgaucauuaucgaaagaaacauuaccgagaucgugcaccucaauucuacaacccuggaaaaggagauuugucccaaaacagcuggauaccgggacuggagcaagccucagugccagaucaccggcuuugcccccuucuccaaagauaacucuauucgccuuagcgccuccggggacaucugggugacgagagaaccuuaugucagcuguggauuuggcaagugcuaccaauucgcucuggggcagggaaccacacucgauaaucggcauucuaacggcaccucccacgaccgcacaccccauagaacccugcugaugaaugagcucggcgugccuuuucaccuggccacgaagcagguuuguaucgcuuggucuagcuccagcugccacgaugggaaagccuggcuucaugugugugucacaggagacgaucggaacgcgaccgccucuauuaucuaugacggcauucugguggauuccaucgggagcugguccaagaauauucuccgcacacaggagucugaaugcguuuguaucaacggaaccugcaccguggucaugacagacggcagcgcuuccgggaaagccgauacgagaauccuguucauucgggagggaaagaucgugcacauuagcccgcuuucuggcuccgcucaacauguggaagagugcagcuguuacccccaguauccugagguccgcugcguuuguagagacaauuggcggggcucuaaccgccccgugcuguacaucaacaugaccgauuauagcauugacuccggguacgugugcucuggacucgucggcgacacaccuagaaaugaugacaucagcuccagcucuaacuguaaagaucccaauaacgaacgcggggccccgggagugaagggcugggcguuugacuccgggaaugaucuguggaugggacggaccaucgagaaggaaagcagaucuggcuacgagacauuccggguuauuggcggguggaacaccgccaauuccaaaagccagacguccagacaggugaucgucgacucugauaacagcuccggauauucuggcauuuuuagcguggaagggaaguccugcaucaaucgcuguuucuacguugagcugauucggggaagaccuaaagagacacgcgugugguggaccagcaacucuaucauugucuuuugcggcaccuccgggacauauggcaccggaagcuggcccgacggcgcuaauaucaacuucauggccaucuga

SEQ ID NO: 206550 - RNA, 1410 nt, Artificial Sequence
  derived and/or modified sequence opt5 from neuraminidase__InfluenzaA__AGQ81732
augaaccccaaucagaagaucauugccaucggcagcgugucccugaccauugcuacaaucugccuccugaugcaagucgccauucuuguuacgaccaugacacugcacuucaaacauaacgaguguucuaauagcuccaacaaucaggcggugccuugcgggccgaucaucauugaaagaaacaucaccgagauugugcaccucaauucuacaacccuggaaaaggagaucugucccaaagcugccggauaccgggacuggagcaagccucagugccagauuacaggcuuugcccccuucuccaaagauaacucuauccgccuuagcgcuuccggggacauuugggucaccagagaaccuuaugugagcuguggacugggcaagugcuaccaauuugcccucgggcagggaacgacccuggauaaucggcauucuaacggcacaucccacgaccgcacaccccauagaacccugcucaugaaugagcugggcguuccuuuccaccuugcuaccaaacagguguguaucgccuggucuagcuccagcugccacgaugggaaggcguggcugcaugucugugugacgggagacgaucggaacgccacagcuucuaucauuuaugacggcauccucguugauuccauugggagcugguccaagaauauccugcgcacccaggagucugaaugcguguguauuaacggaacaugcaccgucgugaugaccgacggcagcgccuccgggaaagcugauacaagaauccuuuuuauccgggagggaaagauugugcacaucagcccgcugucuggcuccgcccaacaugucgaagagugcagcuguuacccccaguauccugagguucgcugcguguguagagacaauuggcggggcucuaaccgccccgugcucuacauuaacauggcggauuauagcaucgacuccggguacgucugcucuggacuggugggcgacacgccuagaaaugaugacauuagcuccagcucuaacuguaaagaucccaauaacgaacgcggggccccgggaguuaagggcugggcuuucgacuccgggaaugaucuguggaugggacggaccaucgagaaggaaagcagaucuggcuacgagacauuucgggugaucggcggguggaacaccgccaauuccaaaagccagacauccagacaggucauuguggacucugauaacagcuccggauauucuggcaucuucagcguugaagggaaguccugcauuaaucgcuguuuuuacguggagcucauccggggaagaccuaaagagacccgcgucugguggacgagcaacucuauuaucguguucugcggcacauccgggaccuauggcaccggaagcuggcccgacggcgcuaauauuaacuuuaugccuaucuga

SEQ ID NO: 206551 - RNA, 1410 nt, Artificial Sequence
  derived and/or modified sequence opt5 from neuraminidase__InfluenzaA__AGQ81733
augaaccccaaucagaagaucauugccaucggcagcgugucccugaccauugcuacaaucugccuccugaugcaaauugccauccuugucacgaccaugacacugcacuucaaacauaacgaguguucuaauagcuccaacucucaggcgguuccuugcgggccgaucauuaucgaaagaaaugugaccgagauugugcaccucaacagcacaacccuggaaaaggagaucugucccaaagcugccgaauaccgggacugguccaagccucagugccagauuacaggauuugcccccuucucuaaagauaauagcauccgccuuuccgcuagcggcgacauuugggucaccagagagccuuaugugucuugugggcugggaaagugcuaccaauuugcccucggccaggggacgacccuggauaaccggcauuccaauggaacaagccacgaccgcacaccccauagaacccugcucaugaacgagcugggcguuccuuuccaccuugcuaccaaacagguguguaucgccuggucuuccagcucuugccacgauggcaaggcguggcugcaugucugugugacgggggacgaucggaaugccacagcuuccaucauuuaugacggaauccucguugauagcauuggcuccuggucuaagaacauccugcgcacccaggaaagcgagugcguguguauuaaugggacaugcaccgucgugaugaccgacggauccgccagcggcaaagcugauacaagaauccuuuuuauccgggaagggaagauugugcacaucucuccgcuguccggaagcgcccaacaugucgaggagugcucuuguuacccccaguauccugaaguucgcugcguguguagagacaacuggcggggcagcaaucgccccgugcucuacauuaacauggcggauuauuccaucgacucuggcuacgucugcagcgggcuggugggagacacgccuagaaacgaugacauuuccucuagcuccaauuguaaagaucccaacaaugagcggggcgccccggggguuaagggaugggcuuucgacagcggcaacgaucuguggauggggcgcaccaucgaaaaggacucuagauccggauacgagacauuucgggugaucggcggcuggaauaccgccaacagcaaaucccagacaucuagacaggucauuguggauagcgacaauuccucuggguauagcggaaucuucuccguugaaggcaagagcugcauuaaccgcuguuuuuacguggagcucauccgggggagaccuaaagagacccgcgucugguggacgucuaauuccauuaucguguucugcggaacaagcggcaccuaugggaccggcucuuggcccgauggagcuaacauuaauuuuaugccuaucuga

SEQ ID NO: 206552 - RNA, 1410 nt, Artificial Sequence
  derived and/or modified sequence opt5 from neuraminidase__InfluenzaA__AGQ81734
augaaccccaaucagaagaucauugccaucggcagcgugucccugaccauugcuacaaucugccuccugaugcaaauugccauccuugucacgaccaugacacugcacuucaaacauaacgaguacucuaauagcuccaacaaucaggcgguuccuugugggccgaucauuaucgaaagaaacauuaccgagaucgugcaccucaauucuacaacccuggaaaaggagauuugccccaaagcugccggauaucgggacuggagcaagccucagugucagaucacaggcuuugcccccuucuccaaagauaacucuauucgccuuagcgcuuccggggacaucugggugaccagagaaccuuacgucagcugcggacugggcaaguguuaucaauuugcccucgggcagggaacgacccuggauaaucggcauucuaacggcacaucccacgaccgcacaccccauagaacccugcucaugaaugagcugggcgugccuuuccaccuugcuaccaagcagguuugcaucgccuggucuagcuccagcugucacgaugggaaagcguggcugcaugugugcgucacgggagacgaucggaacgccacagcuucuauuaucuacgacggcauucucguggauuccaucgggagcugguccaagaauauucugcgcacccaggagucuaaauguguuugcaucaagagaacauguaccguggucaaaaccgacggaagcgccuccggcaaggcugauacacggauccuuuuuauucgcgaagggaagaucgugcacauuagcccgcugucuggauccgcccaacauguggaggaaugcagcugcuauccccaguacccugaggucagauguguuugccgggacaacuggcgcggcucuaauagacccgugcucuauaucaacauggcggauuacagcauugacuccggcuacguguguucugggcuggucggagacacgccucggaacgaugacaucagcuccagcucuaauugcaaagaucccaacaaugagcgcggcgccccgggggugaagggaugggcuuucgacuccggcaacgaucuguggauggggagaaccaucgaaaaagagagccggucuggauaugaaacauuuagaguuauuggcggcuggaauaccgccaacuccaagagccagacaucccgccaggugaucgucgacucugauaauagcuccggguacucuggaauuuucagcguggagggcaaauccuguaucaaccggugcuuuuauguugaacucauuagagggcgcccuaaggagacccgggugugguggacgagcaauucuaucauugucuucuguggaacauccggcaccuacgggaccggcagcuggcccgacggagcuaacaucaauuuuauggccaucuga

SEQ ID NO: 206553 - RNA, 1410 nt, Artificial Sequence; identical to SEQ ID NO: 206551
  derived and/or modified sequence opt5 from neuraminidase__InfluenzaA__AGQ81735

SEQ ID NO: 206554 - RNA, 1410 nt, Artificial Sequence
  derived and/or modified sequence opt5 from neuraminidase__InfluenzaA__AGQ81736
augaaccccaaucagaagaucauugccaucggcagcgugucccugaccauugcuacaaucugccuccugaugcaaauugccauccuugucgcgacgaugacccugcacucuaaacauggggaguguacagacagcuccaacaaucaggcuguuccuugcggaccgaucauuaucgaaagaaacgugaccgagauugugcaccucaauucuacaacccuggaaaaggagaucugucccaaagccgccggcuacaaggauuggagcaaaccucagugccagauuacaggguucgcucccuuuuccaaggacaacucuauccggcuuagcgccuccggagauauuugggucacccgcgaaccuuaugugagcuguggccuggggaagugcuaccaauucgcucucggacagggcacgacccuggacaauagacauucuaacggcacaucccacgaucggacaccccaucgcacccugcucaugaaugagcuggggguuccuuuucaccuugccaccaaacagguguguaucgcguggucuagcuccagcugccacgacggaaaggccuggcugcaugucugugugacgggcgaugacagaaacgcuacagccucuaucauuuaugaugggaugcucguugacuccaucggaagcugguccaaaaauauucugcggacccaggagucugaaugcguguguaucaacggcacaugcaccgucgugaugaccgaugggagcgcuuccggaaaggccgacacacgcauucuuuucaucagagagggcaaaaucgcgcacauuagcccgcugucuggcuccgcccaacauguggaagagugcagcuguuacccccaguauccugagguccggugcguuugucgcgauaauuggagagggucuaaccggcccgugcucuacaucaauauggcugacuauagcguggacuccggauacgucugcucuggccuggugggggauacgccucgcaacgacgauaccagcuccagcucuaacuguaaggaccccaauaacgaaagaggagccccgggcguuaaggggugggcuuuugauuccggaaaugacauuuggaugggccggacaaucgagaaagauagccgcucuggcuacgaaaccuucagagugauugggggauggaacacagccaauuccaagagccagaccucccggcaggucaucguggacucugauaacagcuccggcuauucugggaucuuuagcguugagggaaaauccugcauuaauagauguuucuacguggaacugauccgcggccggccuaaggagacgagagucugguggacaagcaacucuauuaucguguuuugcgggaccuccggcaccuauggaacaggcagcuggcccgacggggccaauauuaacuucaugccuaucuga

SEQ ID NO: 206555 - RNA, 1410 nt, Artificial Sequence
  derived and/or modified sequence opt5 from neuraminidase__InfluenzaA__AGQ81737
augaaccccaaucagaagaucauugccaucggcagcgugucccugaccauugcuacaaucugccuccugaugcaaauugccauccuugucacgaccaugacacugcacuucaaacauaacgaguguucuaauagcuccaacaaucaggcgguuccuugcgggccgaucauuaucgaaagaaacauuaccgagaucgugcaccucaauucuacaacccuggaaaaggagauuugucccaaagcugccggauaccgggacuggagcaagccucagugccagaucacaggcuuugcccccuucuccaaagauaacucuauucgccuuagcgcuuccggggacaucugggugaccagagaaccuuaugucagcuguggacugggcaagugcuaccaauuugcccucgggcagggaacgacccuggauaaucggcauucuaacggcacaucccacgaccgcacaccccauagaacccugcucaugaaugagcugggcgugccuuuccaccuugcuaccaagcagguuuguaucgccuggucuagcuccagcugccacgaugggaaagcguggcugcaugugugugucacgggagacgaucggaacgccacagcuucuauuaucuaugacggcauucucguggauuccaucgggagcugguccaagaauauucugcgcacccaggagucugaaugcguuuguaucaacggaacaugcaccguggucaugaccgacggcagcgccuccgggaaagcugauacaagaauccuuuuuauucgggagggaaagaucgugcacauuagcccgcugucuggcuccgcccaacauguggaagagugcagcuguuacccccaguauccugagguccgcugcguuuguagagacaauuggcggggcucuaaccgccccgugcucuacaucaacauggcggauuauagcauugacuccggguacgugugcucuggacuggucggcgacacgccuagaaaugaugacaucagcuccagcucuaacuguaaagaucccaauaacgaacgcggggccccgggagugaagggcugggcuuucgacuccgggaaugaucuguggaugggacggaccaucgagaaggaaagcagaucuggcuacgagacauuucggguuauuggcggguggaacaccgccaauuccaaaagccagacauccagacaggugaucgucgacucugauaacagcuccggauauucuggcauuuucagcguggaagggaaguccugcaucaaucgcuguuuuuacguugagcucauucggggaagaccuaaagagacccgcgugugguggacgagcaacucuaucauugucuucugcggcacauccgggaccuauggcaccggaagcuggcccgacggcgcuaauaucaacuuuauggccaucuga

SEQ ID NO: 206556 - RNA, 1410 nt, Artificial Sequence
  derived and/or modified sequence opt5 from neuraminidase__InfluenzaA__AGQ81738
augaaccccaaucagaagaucauugccaucggcagcgugucccugaccauugcuacaaucugccuccugaugcaagucgccauucuuguuacgaccaugacacugcacuucaaacauaacgaguguucuaauagcuccaacaaucaggcggugccuugcgggccgaucaucauugaaagaaacaucaccgagauugugcaccucaauucuacaacccuggaaaaggagaucugucccaaagcugccggauaccgggacuggagcaagccucagugccagauuacaggcuuugcccccuucuccaaagauaacucuauccgccuuagcgcuuccggggacauuugggucaccagagaaccuuaugugagcuguggacugggcaagugcuaccaauuugcccucgggcagggaacgacccuggauaaucggcauucuaacggcacaucccacgaccgcacaccccauagaacccugcucaugaaugagcugggcguuccuuuccaccuugcuaccaaacagguguguaucgccuggucuagcuccagcugccacgaugggaaggcguggcugcaugucugugugacgggagacgaucggaacgccacagcuucuaucauuuaugacggcauccucguugauuccauugggagcugguccaagaauauccugcgcacccaggagucugaaugcguguguauuaacggaacaugcaccgucgugaugaccgacggcagcgccuccgggaaagcugauacaagaauccuuuuuauccgggagggaaagauuauccacauuagcccgcugucuggcuccgcccaacauguggaagagugcagcuguuacccccaguauccugagguccgcugcguuuguagagacaauuggcggggcucuaaccgccccgugcucuacaucaacauggcggauuauagcauugacuccggguacgugugcucuggacuggucggcgacacgccuagaaaugaugacaucagcuccagcucuaacuguaaagaucccaauaacgaacgcggggccccgggagugaagggcugggcuuucgacuccgggaaugaucuguggaugggacggaccaucgagaaggaaagcagaucuggcuacgagacauuucggguuauuggcggguggaacaccgccaauuccaaaagccagacauccagacaggugaucgucgacucugauaacagcuccggauauucuggcauuuucagcguggaagggaaguccugcaucaaucgcuguuuuuacguugagcucauucggggaagaccuaaagagacccgcgugugguggacgagcaacucuaucauugucuucugcggcacauccgggaccuauggcaccggaagcuggcccgacggcgcuaauaucaacuuuaugccuaucuga

SEQ ID NO: 206557 - RNA, 1410 nt, Artificial Sequence
  derived and/or modified sequence opt5 from neuraminidase__InfluenzaA__AGQ81739
augaaccccaaucagaagaucauugccaucggcagcgugucccugaccauugcuacaaucugccuccugaugcaaauugccauccuugucacgaccaugacacugcacuucaaacaugacgaguguaccaacucuagcaauaaccaggcgguuccuugcgaaccgaucauuaucgagagaaaugugacagaaauugugcacaucaacuccaccauucucgagaaggaaaucugucccaaagcugccggguaccggaauuggucuaagccucagugccagauuacaggauuugcccccuucagcaaagauaacuccauccgccugucugcuagcggcgacaucugggucaccagagagccuuauguguccugugggcuuggaaagugcuaccaauuugcccugggccaggggacgacccucgauaaucggcauagcaacggaacacugaaugaccgcacaccccacagaacccugcucaugaacgagcugggcguuccuuuccaucuugcuaccaaacagguguguauugccuggucuuccagcucuugccacgauggcaaggcguggcugcacgucugugugacgggggacgaucggaaugccacagcuuccaucauuuaugacgauaugcucguugacagcaucggaucuugguccaagaacauucugcgcacccaggaaagcgagugcguguguaucaauggcacaugcaccgucgugaugaccgauggguccgccucuggaaaagcugacacaagaauccuuuuuauucgggaaggcaagaucgugcauauuagcccgcuguccgggagcgcccaacacgucgaggagugcucuuguuacccccaguauccugaaguucgcugcguguguagagauaacuggcggggauccaaccgccccgugcucuacaucaauauggcggacuauagcauugacucuggcuacgucugcagcggccuggugggggauacgccuagaaacgacgauaucuccucuagcuccaauuguaaagaccccaacaaugagcggggagccccgggcguuaaggggugggcuuucgauagcggaaacgacaucuggaugggccgcaccauugaaaaggauucuagauccggguacgagacauuucgggugaucggaggcuggaauaccgccaacagcaaaucucagacauccagacaggucauuguggacagcgauaauuccucuggcuauagcgggaucuucuccguugaaggaaagucuugcauuaaccgcuguuuuuacguggagcugauccggggcagaccuaaagagacccgcgucugguggacgagcaauuccauuaucguguucugcgggacaagcggaaccuauggcaccgggucuuggcccgacggcgcuaacaucaauuuuauggccauuuga

SEQ ID NO: 206558 - RNA, 1410 nt, Artificial Sequence
  derived and/or modified sequence opt5 from neuraminidase__InfluenzaA__AGQ81740
augaaccccaaucagaagaucguggccauuggcagcgucucccugaccaucgcuacaauuugccuccugaugcaaaucgccauucuuguuacgaccaugacacugcacuucaaacauggggaguguaccaacucuagcaauaaccaggcggugccuugcggaccgaucaucauugaaagaaauaucacagagauugugcaccucaacuccaccacacuggaaaaggagaucugucccaaagcugccggcuaccgggacuggucuaagccucagugccagauuaccggguuugcccccuucagcaaagauaauuccauccgccuuucugcuagcggagacauuugggucacgagagaaccuuauguguccuguggccuggggaagugcuaccaauuugcccucggacagggcaccacacuggauaaccggcauagcaauggcaccucucacgaccgcacaccccauagaacccugcucaugaacgagcuggggguuccuuuccaccuugcuacgaaacagguguguaucgccugguccucuagcuccugccacgauggaaaggcguggcugcaugucugugugacaggcgacgaucggaaugccaccgcuagcaucauuuauaacgggauccucguugacucuauuggauccuggagcaagaauauccugcgcacacaggaguccgaaugcguguguauuaacgggaccugcaccgucgugaugacagauggcucugccagcggaaaagcugacacgagaauccuuuuuauccgggagggcaagauugugcacaucuccccgcugagcggcucugcccaacaugucgaagagugcuccuguuacccccaguauccugagguucgcugcguguguagagauaauuggcgggggagcaaccgccccgugcucuacauuaacauggcggacuauucugucgauagcggauacgugugcuccggccugguuggggacaccccuagaaaugacgauacaucuagcuccagcaacuguaaagaccccaauaacgaacggggagccccgggcgugaaggggugggcuuucgauucuggaaaugacaucuggaugggccgcaccauugagaaggaucugagauccggcuacgaaacauuucgggucaucgggggauggaacaccgccaauagcaaaucucagacguccagacaggugaucguugacagcgauaacuccucuggcuauagcgggauuuucuccguggagggaaagucuugcaucaaucgcuguuuuuacgucgaacucauucggggcagaccuaaagagacacgcgugugguggaccagcaacuccaucauugucuucugcgggaccagcggcacauauggaaccggcucuuggcccgacggggcuaauaucaacuuuaugccuauuuga

SEQ ID NO: 206559 - RNA, 1410 nt, Artificial Sequence
  derived and/or modified sequence opt5 from neuraminidase__InfluenzaA__AGQ81741
augaaccccaaucagaagaucguggccauuggcagcgucucccugaccaucgcuacaauuugccuccugaugcaaaucgccauucuuguuacgaccaugacacugcacuucaaacauggggaguguaccaacucuagcaauaaccaggcggugccuugcggaccgaucaucauugaaagaaauaucacagagauugugcaccucaacuccaccacacuggacaaggaaaucugucccaaagcugccggcuaccgggauuggucuaagccucagugccagauuaccggguuugcccccuucagcaaagacaauuccauccgccuuucugcuagcggagauauuugggucacgagagagccuuauguguccuguggccuggggaagugcuaccaauuugcccucggacagggcaccacacuggacaaccggcauagcaauggcaccucucacgaucgcacaccccauagaacccugcucaugaacgaacuggggguuccuuuccaccuugcuacgaaacagguguguaucgccugguccucuagcuccugccacgacggaaaggcguggcugcaugucugugugacaggcgaugaccggaaugccaccgcuagcaucauuuaugaugggaugcucguugacucuaucggauccuggagcaagaacauucugcgcacacaggaguccgagugcguguguaucaaugggaccugcaccgucgugaugacagauggcucugccagcggaaaagcugacacgcggauucuuuuuaucagagaaggcaagaucgugcacauuuccccgcugagcggcucugcccaacaugucgaggaaugcuccuguuacccccaguauccugagguucgcugcguguguagagauaacuggcgggggagcaaucgccccgugcucuacaucaacauggcggacuauucugucgacagcggauacgugugcuccggccugguuggggauaccccuagaaacgacgauacaucuagcuccagcaauuguaaagaccccaacaaugagcggggagccccgggcgugaaggggugggcuuucgauucuggaaacgacauuuggaugggccgcaccaucgaaaaggaucugagauccggcuacgagacauuucgggucauugggggauggaauaccgccaacagcaaaucucagacguccagacaggugaucguugacagcgauaauuccucuggcuauagcgggaucuucuccguggaaggaaagucuugcauuaaccgcuguuuuuacgucgagcucauccggggcagaccuaaagaaacacgcgugugguggaccagcaauuccauuaucgucuucugcgggaccagcggcacauauggaaccggcucuuggcccgacggggcuaacauuaauuuuaugccuaucuga

SEQ ID NO: 206560 - RNA, 1410 nt, Artificial Sequence
  derived and/or modified sequence opt5 from neuraminidase__InfluenzaA__AGQ81742
augaaccccaaucagaagaucguggccauuggcagcgucucccugaccaucgcuacaauuugccuccugaugcaaaucgccauucuuguuacgaccaugacacugcacuucaaacauggggaguguaccaacucuagcaauaaccaggcggugccuugcggaccgaucaucauugaaagaaauaucacagagauugugcaccucaacuccaccacacuggaaaaggagaucugucccaaagcugccgaauaccgggacuggucuaagccucagugccagauuaccggcuuugcccccuucagcaaagauaauuccauccgccuuucugcuagcggggacauuugggucacgagagagccuuauguguccuguggacugggcaagugcuaccaauuugcccucgggcagggaaccacacuggauaaccggcauagcaauggcaccucucacgaccgcacaccccauagaacccugcucaugaacgagcugggcguuccuuuccaccuugcuacgaaacagguguguaucgccugguccucuagcuccugccacgaugggaaggcguggcugcaugucugugugacaggagacgaucggaaugccaccgcuagcaucauuuaugacggcaugcucguugauucuaucggguccuggagcaagaacauucugcgcacacaggaauccgagugcguguguaucaauggaaccugcaccgucgugaugacagacggcucugccagcgggaaagcugauacgcggauucuuuuuauccgggaaggaaagaucgugcacauuuccccgcugagcggcucugcccaacaugucgaggagugcuccuguuacccccaguauccugaaguucgcugcguguguagagacaacuggcggggcagcaaucgccccgugcucuacaucaacauggcggauuauucugucgacagcggguacgugugcuccggacugguuggcgacaccccuagaaacgaugacacaucuagcuccagcaauuguaaagaucccaacaaugagagaggggccccgggagugaagggcugggcuuucgacucugggaacgauauuuggaugggacgcaccaucgaaaaggaccugagauccggcuacgagacauuucgggucauuggcggguggaauaccgccaacagcaaaucucagacguccagacaggugaucguugauagcgacaauuccucuggauauagcggcaucuucuccguggaagggaagucuugcauuaaccgcuguuuuuacgucgagcucauccggggaagaccuaaagagacacgcgugugguggaccagcaauuccauuaucgucuucugcggcaccagcgggacauauggcaccggaucuuggcccgauggcgcuaacauuaauuuuaugccuaucuga

SEQ ID NO: 206561 - RNA, 1410 nt, Artificial Sequence
  derived and/or modified sequence opt5 from neuraminidase__InfluenzaA__AGQ81744
augaaccccaaucagaagaucauugccaucggcagcgugucccugaccauugcuacaaucugccuccugaugcaaauugccauccuugucacgaccaugacacugcacuucagacaugacgaguguaccaacucuagcaauaaccaggcgguuccuugcgggccgaucauuaucgaacggaaugugacagagauugugcaccucaacuccaccacacuggaaaaagagaucugucccaaggcugccgaauaccgcgauuggucuaaaccucagugccagauuaccggauuuguccccuucagcaaggacaauuccaucagacuuucugccggcggggauauuugggugacgcgggagccuuauguuagcuguggacugggcaaaugcuaccaauuugcucucgggcagggaaccacacuggacaaccgccauuccaauggcaccagccacgauagaacaccccaucggacccugcucaugaacgagcugggcgugccuuuccaccuugccacgaagcaggucuguaucgcuuggucuuccagcucuugccacgacgggaaggccuggcugcauguguguguuacaggagaugaccgcaaugcgaccgccuccaucauuuaugauggcaugcucguggacagcaucgggucuugguccaaaaacauucugagaacacaggaaagcgagugcgucuguaucaauggaaccugcaccguggugaugacagauggcuccgcuucugggaaggccgacacgcggauucuuuuuauccgcgaaggaaaaaucguccacauuagcccgcuguccggcagcgcucaacauguugaggagugcucuuguuacccccaguauccugaagugagaugcgugugucgggauaacuggcgcggcuccaauagacccguccucuacaucaacguggccgacuauagcguugacucuggguacgugugcagcggacuggucggcgauaccccucggaacgacgauauuuccucuagcuccaauuguaaggaccccaacaaugagcgcggggcgccgggagugaaaggcugggccuucgauagcgggaacgacaucuggaugggaagaacaauugaaaaggauucucgguccggcuacgagaccuuuagaguuaucggcggguggaauacagcuaacagcaagucucagaccucccgccaggugaucgucgacagcgauaauccuuccggauauucuggcauuuucagcguggaagggaaauccugcaucaaccgguguuuuuacgucgagcugauuagaggacgccccaaggagacgcgggugugguggacaucuaauagcaucauuguuuucugcggcaccuccgggaccuauggcacaggaagcuggccugacggcgccaacaucaauuuuaugcccauuuga

SEQ ID NO: 206562 - RNA, 1410 nt, Artificial Sequence
  derived and/or modified sequence opt5 from neuraminidase__InfluenzaA__AGQ81746
augaaccccaaucagaagaucauugccaucggcagcgugucccugaccauugcuacaaucugccuccugaugcaaauugccauccuugucacgaccaugacacugcacuucaaacauaacgaguguucuaauagcuccaacucucaggcgguuccuugcgggccgaucauuaucgaaagaaaugugaccgagauugugcaccucaacagcacaacccuggaaaaggagaucugucccaaagcugccgaauaccggggaugguccaagccucagugccagauuacaggcuuugcccccuucucuaaagacaauagcauccgccuuuccgcuagcggggauauuugggucaccagagagccuuaugugucuugugaccugggaaagugcuaccaauuugcccucggccaggggacgacccuggauaaccggcauuccaauggaacaagccacgaccgcacaccccauagaacccugcucaugaacgagcugggcguuccuuuccaccuugcuaccaaacagguguguaucgccuggucuuccagcucuugccacgauggcaaggcguggcugcaugucugugugacgggggacgaucggaaugccacagcuuccaucauuuaugacggaauccucguugauagcauuggcuccuggucuaagaacauccugcgcacccaggaaagcgagugcguguguauuaaugggacaugcaccgucgugaugaccgacggauccgccagcggcaaagcugauacaagaauccuuuuuauccgggaagggaagauugugcacaucucuccgcuguccggaagcgcccaacaugucgaggagugcucuuguuacccccaguauccugaaguucgcugcguguguagagacaacuggcggggcagcaaucgccccgugcucuacauuaacauggcggauuauuccaucgacucuggcuacgucugcagcgggcuggugggagacacgccuagaaacgaugacauuuccucuagcuccaauuguaaagaucccaacaaugagcggggcgccccggggguuaagggaugggcuuucgacagcggcaacgaucuguggauggggcgcaccaucgaaaaggacucuagauccggauacgagacauuucgggugaucggcggcuggaauaccgccaacagcaaaucccagacaucuagacaggucauuguggauagcgacaauuccucuggguauagcggaaucuucuccguugaaggcaagagcugcauuaaccgcuguuuuuacguggagcucauccgggggagaccuaaagagacccgcgucugguggacgucuaauuccauuaucguguucugcggaacaagcggcaccuaugggaccggcucuuggcccgauggagcuaacauuaauuuuaugccuaucuga

SEQ ID NO: 206563 - RNA, 1410 nt, Artificial Sequence
  derived and/or modified sequence opt5 from neuraminidase__InfluenzaA__AGQ81747
augaaccccaaucagaagaucguggccauuggcagcgucucccugaccaucgcuacaauuugccuccugaugcaaaucgccauucuuguuacgaccaugacacugcacuucaaacauggggaguguaccaacucuagcaauaaccaggcggugccuugcggaccgaucaucauugaaagaaauaucacagagauugugcaccucaacuccaccacacuggaaaaggagaucugucccaaagcugccggcuaccgggacuggucuaagccucagugccagauuaccggguuugcccccuucagcaaagauaauuccauccgccuuucugcuagcggagacauuugggucacgagagaaccuuauguguccuguggccuggggaagugcuaccaauuugcccucggacagggcaccacacuggauaaccggcauagcaauggcaccucucacgaccgcacaccccauagaacccugcucaugaacgagcuggggguuccuuuccaccuugcuacgaaacagguguguaucgccugguccucuagcuccugccacgauggaaaggcguggcugcaugucugugugacaggcgacgaucggaaugccaccgcuagcaucauuuaugacgggaugcucguugauucuaucggauccuggagcaagaacauucugcgcacacaggaguccgaaugcguguguaucaaugggaccugcaccgucgugaugacagacggcucugccagcggaaaagcugauacgcggauucuuuuuaucagagagggcaagaucgugcacauuuccccgcugagcggcucugcccaacaugucgaagagugcuccuguuacccccaguauccugagguucgcugcguguguagagacaacuggcgggggagcaaucgccccgugcucuacaucaacauggcggauuauucugucgacagcggauacgugugcuccggccugguuggggacaccccuagaaacgaugacacaucuagcuccagcaauuguaaagaucccaacaaugaacggggagccccgggcgugaaggggugggcuuucgacucuggaaacgauauuuggaugggccgcaccaucgagaaggaccugagauccggcuacgaaacauuucgggucauugggggauggaauaccgccaacagcaaaucucagacguccagacaggugaucguugauagcgacaauuccucuggcuauagcgggaucuucuccguggagggaaagucuugcauuaaccgcuguuuuuacgucgaacucauccggggcagaccuaaagagacacgcgugugguggaccagcaauuccauuaucgucuucugcgggaccagcggcacauauggaaccggcucuuggcccgauggggcuaacauuaauuuuaugccuaucuga

SEQ ID NO: 206564 - RNA, 1401 nt, Artificial Sequence
  derived and/or modified sequence opt5 from neuraminidase__InfluenzaA__AGQ81749
augaaccccaaucagaagaucauugccaucggcagcgugucccugaccacagcuauuaucugcuuccucaugcaaauugccauccugacgaccacaaugacccuucacuuuaaacagaacgaguguucuaauccuagcaacaaucaggucguuccgugcgaacccaucauuaucgagagaaacacagugcaucugaauagcaccacaauugaaaaggagaucuguucuaaaguggcggaauacaagaacuggagcaaaccucagugccaaauuaccggguucgcucccuuuuccaaggacaauucuauccggcucagcgccggaggcgauauuugggucacgcgcgagccuuauguguccuguagccuggggaagugcuaccaguucgcccuuggacagggcaccacacugaaaaacaagcacucuaaugggaccacacaugacagaaucccccaccggacccuccugaugaacgagcugggaguuccuuuucaucucggcacgaaacagguguguaucgcuugguccuccucuuccugcuaugauggcaaggccuggcugcacauuugugucacaggggacgauaaaaaugcuaccgccagcaucauuuacgacggaaugcuugcggauucuaucggcuccuggagcaagaacauucugcgcacacaagaauccgagugcguguguaucaaugggaccugcgccguugugaugaccgacggaucugcuagcggcaaggccgauacaagaauccucuucauucgggaagggcgcaucauuaacaucuccccgcugagcggaucugcucagcacgucgaggagugcuccuguuaucccagauacccugaagugcggugcgugugucgcgacaacuggaaaggcagcaauagacccguccuuuauauuaacauggccgauuacucuguugagagcuccuacgugugcucuggccuggugggggacacgccucggaaugaugacagcuccuccucuuccaacugucgcgaccccaauaacgaaagaggagcgccgggcgucaaggggugggccuuugaugacggaaaugauguguggaugggccggaccaucaaaaaggacagccgcucuggguaugagacauucagaguuaucaacggauggaccacagcuaauuccaaaagccagauuaacagacaggugaucgucgauuccgacaauuggucuggcuacagcggcauuuuuagcguggaagggaagaacugcaucaaucgguguuucuauguugagcucauucgcggacggccucaagagcccaaagugugguggaccucuaacagcaucauugccuuuugcggcacguccgggacauacggaaccggcagcuggccugauggggcuaauaucaacuucaugcccaucuga

SEQ ID NO: 206565 - RNA, 1401 nt, Artificial Sequence; identical to SEQ ID NO: 206564
  derived and/or modified sequence opt5 from neuraminidase__InfluenzaA__AGQ81750

SEQ ID NO: 206566 - RNA, 1410 nt, Artificial Sequence
  derived and/or modified sequence opt5 from neuraminidase__InfluenzaA__AGQ81751
augaaccccaaucagaagaucauugccaucggcagcgugucccugaccauugcuacaaucugccuccugaugcaaauugccauccuugucacgaccaugacacuguacuucaaacacaacgaguguucuaauagcuccaacaaucaggcgguuccuugcgggccgaucauuaucgaaagaaacauuaccgagaucgugcaucucaauucuacaacccuggaaaaggagauuugucccaaagcugccggauaucgggacuggagcaagccucagugccagaucacaggcuuugcccccuucuccaaagauaacucuauucgccuuagcgcuuccggggacaucugggugaccagagaaccuuacgucagcuguggacugggcaagugcuaucaauuugcccucgggcagggaacgacccuggauaaucggcacucuaacggcacaucccaugaccgcacaccccacagaacccugcucaugaaugagcugggcgugccuuuccaucuugcuaccaagcagguuuguaucgccuggucuagcuccagcugccacgaugggaaagcguggcugcacgugugugucacgggagacgaucggaacgccacagcuucuauuaucuacgacggcauucucguggauuccaucgggagcugguccaagaauauucugcgcacccaggagucugaaugcguuuguaucaacggaacaugcaccguggucaugaccgacggcagcgccuccgggaaagcugauacaagaauccuuuuuauucgggagggaaagaucgugcauauuagcccgcugucuggcuccgcccaacacguggaagagugcagcuguuauccccaguacccugagguccgcugcguuuguagagacaauuggcggggcucuaaccgccccgugcucuauaucaacauggcggauuacagcauugacuccggguacgugugcucuggacuggucggcgacacgccuagaaaugaugacaucagcuccagcucuaacuguaaagaucccaauaacgaacgcggggccccgggagugaagggcugggcuuucgacuccgggaaugaucuguggaugggacggaccaucgagaaggaaagcagaucuggcuaugagacauuucggguuauuggcggguggaacaccgccaauuccaaaagccagacauccagacaggugaucgucgacucugauaacagcuccggauacucuggcauuuucagcguggaagggaaguccugcaucaaucgcuguuuuuauguugagcucauucggggaagaccuaaagagacccgcgugugguggacgagcaacucuaucauugucuucugcggcacauccgggaccuacggcaccggaagcuggcccgacggcgcuaauaucaacuuuaugccuaucuga

SEQ ID NO: 206567 - RNA, 1410 nt, Artificial Sequence
  derived and/or modified sequence opt5 from neuraminidase__InfluenzaA__AGQ81753
augaaccccaaucagaagaucguggccauuggcagcgucucccugaccaucgcuacaauuugccuccugaugcaaaucgccauucuuguuacgaccaugacacugcacuucaaacauggggaguguaccaacucuagcaauaaccaggcggugccuugcggaccgaucaucauugaaagaaauaucacaggcauugugcaccucaacuccaccacacuggagaaggaaaucugucccaaagcugccggguaccgggacuggucuaagccucagugccagauuaccggauuugcccccuucagcaaagauaauuccauccgccuuucugcuagcggcgacauuugggucacgagagagccuuauguguccugugggcugggaaagugcuaccaauuugcccucggccagggcaccacacuggauaaccggcauagcaaugggaccucucacgaccgcacaccccauagaacccugcucaugaacgaacugggaguuccuuuccaccuugcuacgaaacagguguguaucgccugguccucuagcuccugccacgauggcaaggcguggcugcauaucugugucacaggggacgaucggaaugccaccgcuagcauuaucuaugacggaaugcucguggauucuauuggcuccuggagcaagaacauccugcgcacacaggaguccgagugcguuuguauuaaugggaccugcaccguggucaugacagacggaucugccagcggcaaagcugauacgagaauccuuuuuauccgggaaggcaagauugugcacaucuccccgcugagcgggucugcccaacauguggaggaaugcuccuguuacccccaguauccugagguccgcugcguuuguagagacaacuggcggggaagcaaucgccccgugcucuacauuaacauggcggauuauucuguggacagcggcuacgucugcuccgggcuggugggagacaccccuagaaacgaugacacaucuagcuccagcaauuguaaagaucccaacaaugagcggggcgccccggggguuaagggaugggcuuucgacucuggcaacgauaucuggaugggccgcaccauugaaaaggaccugagauccggguacgagacauuucgggugaucggaggcuggaauaccgccaacagcaaaucucagacgaauagacaggucaucguggauuccgacaacagcuccggguauucuggaauuuucagcguugaaggcaaguccugcaucaaucgcuguuuuuacguggagcucauucgggggagaccuaaagaaacacgcgucugguggaccucuaacagcaucauuguguucugcggcaccuccggaacauauggcaccgggagcuggcccgauggagcuaauaucaacuuuaugccuauuuga

SEQ ID NO: 206568 - RNA, 1410 nt, Artificial Sequence; identical to SEQ ID NO: 206567
  derived and/or modified sequence opt5 from neuraminidase__InfluenzaA__AGQ81754

SEQ ID NO: 206569 - RNA, 1410 nt, Artificial Sequence
  derived and/or modified sequence opt5 from neuraminidase__InfluenzaA__AGQ81756
augaaccccaaucagaagaucauugccaucggcagcauuucccugaccaucgcuacaauuugccuccugauccaaaucgccauucuugugacgaccaugacacugcacuucaaacauggggaguguaccaacucuagcaauaaccaggcggucccuugcggaccgaucauuaucgaaagaaauguuacagagauugugcaccucaacuccaccacacuggaaaaggagaucugucccaaagcugccggcuaccgggacuggucuaagccucagugccagauuaccggguuugcccccuucagcaaagauaauuccauccgccuuucugcuagcggagacaucugggugacgagagaaccuuaugucuccuguggccuggggaagugcuaccaauuugcccucggacagggcaccacacuggauaaccggcauagcaauggcaccucucacgaccgcacaccccauagaacccugcucaugaacgagcugggggugccuuuccaccuugcuacgaagcagguuuguauugccugguccucuagcuccugccacgauggaaaagcguggcugcaugugugugucacaggcgacgaucggaaugccaccgcuagcaucauuuaugacgggcuccugguggauucuaucggauccuggagcaagaacauucuucgcacacaggaguccgaaugcguuuguaucaaugggaccugcaccguggucaugacagacggcucugccagcggaaaagcugauacgagaauccuguuuauucgggagggcaagaucauucacaucuccccgcucagcggcucugcccaacauguggaagagugcuccuguuacccccaguauccugaggugcgcugcgucuguagagacaacuggcgggggagcaaucgccccguucuguacauuaacauggcggauuauucuguggacagcggauacgugugcuccggccuggucggggacaccccuagaaacgaugacacaucuagcuccagcaauuguaaagaucccaacaaugaacggggagccccgggcgugaaggggugggcuuucgacucuggaaacgauaucuggaugggccgcaccaucgagaaggacuccagaagcggcuacgaaacauuucggguuauugggggauggaauaccgccaacucuaaaucccagacgagcagacaggugaucgucgauuccgacaauucuagcggcuauuccgggauuuucucuguggagggaaagagcugcaucaaccgcuguuuuuacguugaacucauucggggcagaccuaaagagacacgcgugugguggaccuccaauagcaucauugucuucugcgggaccucuggcacauauggaaccggcuccuggcccgauggggcuaacaucaauuuuaugccuaucuga

SEQ ID NO: 206570 - RNA, 1410 nt, Artificial Sequence
  derived and/or modified sequence opt5 from neuraminidase__InfluenzaA__AGQ81757
augaaccccaaucagaagaucauugccaucggcagcgugucccugaccauugcuacaaucugccuccugauucaaaucgccauccuugucacgaccaugacacugcacuucaaacauggggaguguaccaacucuagcaauaaccaggcgguuccuugcggaccgauuaucauugaaagaaaugugacagagaucgugcaccucaacuccaccacacuggaaaaggagauuugucccaaagcugccggcuaccgggacuggucuaagccucagugccagaucaccggguuugcccccuucagcaaagauaauuccauucgccuuucugcuagcggagacaucugggucacgagagaaccuuauguguccuguggccuggggaagugcuaccaauuugcccucggacagggcaccacacuggauaaccggcauagcaauggcaccucucacgaccgcacaccccauagaacccugcucaugaacgagcuggggguuccuuuccaccuugcuacgaaacagguguguaucgccugguccucuagcuccugccacgauggaaaggcguggcugcaugucugugugacaggcgacgaucggaaugccaccgcuagcauuaucuaugacgggcuccugguugauucuauuggauccuggagcaagaacauccuucgcacacaggaguccgaaugcguguguauuaaugggaccugcaccgucgugaugacagacggcucugccagcggaaaagcugauacgagaauccuguuuauccgggagggcaagauuauccacauuuccccgcucagcggcucugcccaacauguggaagagugcuccuguuacccccaguauccugagguccgcugcguuuguagagacaacuggcgggggagcaaucgccccgugcuguacaucaacauggcggauuauucuguggacagcggauacgucugcuccggccuggugggggacaccccuagaaacgaugacacaucuagcuccagcaauuguaaagaucccaacaaugaacggggagccccgggcguuaaggggugggcuuucgacucuggaaacgauauuuggaugggccgcaccaucgagaaggacuccagaagcggcuacgaaacauuucgggugaucgggggauggaauaccgccaacucuaaaucccagacgagcagacaggucauuguggauuccgacaauucuagcggcuauuccgggaucuucucuguugagggaaagagcugcauuaaccgcuguuuuuacguggaacucauccggggcagaccuaaagagacacgcgucugguggaccuccaauagcauuaucguguucugcgggaccucuggcacauauggaaccggcuccuggcccgauggggcuaacauuaauuuuaugccuaucuga

SEQ ID NO: 206571 - RNA, 1401 nt, Artificial Sequence
  derived and/or modified sequence opt5 from neuraminidase__InfluenzaA__AGQ81758
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucguuccgugcgaacccacaaucauugagcggaacaccgugcaucucaauuccacaaccaucgaacgcgagauuuguccuaaaguggcggaauacaagaacuggucuaaaccccagugccaaaucacaggguuugcuccuuucagcaaggacaauuccauuagacugucugccggaggcgauaucugggucacccgggagcccuaugugagcuguucccuugggaaaugcuaccaguuugcccugggacagggcacgacccucaagaacaagcacagcaaugggacaacccaugaccgcacaccucacagaacccugcugaugaacgagcucggaguuccguuccaucugggcacgaaacagguguguaucgcuuggucuuccagcucuugcuaugauggcaaggccuggcuucacauuugugucacaggggacgaugaaaaugcuaccgccuccaucauuuacgacggaaugcugguggauagcaucggcucuugguccaaaaacauucuccggacacaagagagcgaaugcguuuguaucaaugggaccugcgcgguggucaugaccgacggauccgccucuggcaaggcugauacacgcgugcuguuuaucagagaggggaaaauuaucaacauuagcccccuuuccggaagcgcccagcacguggaggaaugcucuuguuauccucgguaccccgagguccgcugcguuuguagagacaacuggaagggcuccaaucggccugugcuguauaucaacauggcugauuacagcauugaaucuagcuacgugugcuccggccucgucggggacacgccccgcaaugaugacucuagcuccagcucuaacuguagagacccgaauaacgagcggggagccccuggcgugaaggggugggcguucgaugacggaaaugauguuuggaugggccgcaccaucaaaaacgacuccagaagcggguaugaaacauuucggguggucaauggauggaccauggccaacucuaagucccagaucaauagacaggugauuguugauagcgacaacugguccggcuacucuggcaucuucagcguggaggggaaaaagugcauuaaucgcuguuuuuaugucgagcugauccggggaagaccccaagaaccucgcgugugguggacauccaacucuauuaucgucuucugcggcaccagcgggacguacggaacaggcuccuggcccgauggggcuaauauuaacuuuaugcccaucuga

SEQ ID NO: 206572 - RNA, 1401 nt, Artificial Sequence
  derived and/or modified sequence opt5 from neuraminidase__InfluenzaA__AGQ81759
augaaccccaaucagaagaucauugccaucggcagcgugucccugaccauugcuaucauuugcuuccucauccaaaucgccauucugacaacgaccaugacacuucacuuuagacagucugaguguagcaacccuuccaauaaccaggucguuccgugcgaacccaucauuaucgagcggaauaccgugcaucugaacucuacaauuaucgaaaaagagauuuguccuaagguggcggaauacaaaaauuggagcaagccccagugccaaaucaccggguucgcuccuuuuuccaaagacaacucuauccgccucagcgccggaggcgauauuugggucacaagagagcccuauguguccuguagccuggggaagugcuaccaguucgcccuuggacagggcaccacgcugaagaauaaacacucuaacgggaccacacaugaccggaucccucaccgcacccuccugaugaaugagcugggaguuccguuucaucucggcacaaaacagguguguauugcuugguccuccucuuccugccacgauggcaaggccuggcugcacaucugugucaccggggacgauaagaacgcuacggccagcauuaucuaugacggaaugcuuguggauucuaucggcuccuggagcaaaaauauucugagaacacaagaauccgagugcguuuguaucaacgggaccugcgcgguggucaugacagacggaucugccagcggcaaggcugauacccggauucucuucauccgcgaagggaagauuaucaauaucagcccccugagcggaucugcccagcauguggaggagugcuccuguuacccuagauaucccgaagugcggugcgucugucgcgacaacuggaaaggcagcaacagaccuguucuuuacauuaauauggcugauuauucuaucgagagcuccuacgugugcucuggccuggugggggacacaccccgggaugacgacagcuccucuagcuccaacugucgcgauccgaauaacgaaagaggagccccuggcgucaaggggugggcguuugacgauggaaaugacauuuggaugggccggaccaucaaaagcgauucucgcuccggguacgagacguucagagugauuaacggauggaccacagccaauagcaagucccagaucaaccggcagguuauuguggacucugauagcugguccggcuauucuggcaucuuuagcgucgaagggaaaaauugcaucaacagauguuucuacguggagcucauucgcggacggcccagagagacccgcguuugguggacauccaauagcaucauuguguuuugcggcaccucugggacguauggaacaggcuccuggccugacggggcuaacaucaauuucaugcccauuuga

SEQ ID NO: 206573 - RNA, 1401 nt, Artificial Sequence
  derived and/or modified sequence opt5 from neuraminidase__InfluenzaA__AGQ81760
augaaccccaaucagaagaucauugccaucggcagcgugucccugaccauugcuaucauuugcuuccucaugcaaaucgccauccugacaacgaccaugacacuucacuuuagacagaacgaguguucuaauccuagcaacaaucaggucguuccgugcgaacccauuaucauugagcggaacaccgugcaucucaauuccacaaccaucgaaaaagagauuuguccuaagguggcggaauacaaaaacuggucuaagccccagugccaaaucacaggguucgcuccuuuuagcaaagacaauuccauucgccucucugccggaggcgauaucugggucaccagagagcccuaugugagcuguucccuggggaagugcuaccaguucgcccuuggacagggcacgacccugaagaacaaacacagcaaugggacaacccaugaccggaucccucaccgcacacuccugaugaacgagcugggaguuccguuucaucucggcaccaaacagguguguauugcuuggucuuccagcucuugccacgauggcaaggccuggcugcacaucugugucacgggggacgauaagaaugcuacagccuccauuaucuaugacggaaugcuuguggauagcauuggcucuugguccaaaaacauccugagaacccaagaaagcgagugcguuuguaucaaugggacaugcgcgguggucaugaccgacggauccgccucuggcaaggcugauacccgggugcuguucauucgcgaagggaagaucauuaacaucagcccccuguccggaagcgcccagcauguggaggagugcucuuguuacccuagauaucccgaaguccggugcguuugucgcgacaacuggaaaggcuccaauagaccugugcuuuacauuaacauggcugauuauagcaucgagucuagcuacgugugcuccggccuggucggggacacaccccgggaugacgacucuagcuccagcucuaauugucgcgauccgaacaaugaaagaggagccccuggcgugaaggggugggcguuugacgauggaaacgacaucuggaugggccggacgauuaaauccgauagccgcucuggguacgagaccuucagaguugugaauggauggaucacagccaacuccaagagccagauuaaucggcaggucaucguggacuccgauucuuggagcggcuauuccggcaucuuuucuguugaagggaaaaacugcauuaauagauguuucuacguggagcucauucgcggacggccccaagagaccagagucugguggacaagcaacuccaucaucguguuuugcggcaccagcgggacguauggaacaggcucuuggccugacggggcuaauauuaacuucaugcccaucuga

SEQ ID NO: 206574 - RNA, 1401 nt, Artificial Sequence
  derived and/or modified sequence opt5 from neuraminidase__InfluenzaA__AGQ81761
augaaccccaaucagaagaucauugccaucggcagcgugucccugaccauugcuaucauuugcuuccucaugcaaaucgccauccugacaacgaccaugacacuucacuuuagacagaacgaguguucuaauccuagcaacaaucaggucguuccgugcgaacccauuaucauugagcggaacaccgugcaucucaauuccacaaccaucgaaaaagagauuuguccuaagguggcggaauacaaaaacuggucuaagccccagugccaaaucacaggguucgcuccuuuuagcaaagacaauuccauucgccugucugccggaggcgauaucugggucaccagagagcccuaugugagcuguucccuggggaagugcuaccaguucgcccuuggacagggcacgacccugaagaacaaacacagcaaugggacaacccaugaccggaucccucaccgcacacuccugaugaacgagcugggaguuccguuucaucucggcaccaaacagguguguauugcuuggucuuccagcucuugccacgauggcaaggccuggcugcacaucugugucacgggggacgauaagaaugcuacagccuccauuaucuaugacggaaugcuuguggauagcauuggcucuugguccaaaaacauccugagaacccaagaaagcgagugcguuuguaucaaugggacaugcgcgguggucaugaccgacggauccgccucuggcaaggcugauacccggauucucuucaucaaggaagggaaaauuaucaacauuagcccccuguccggaagcgcccagcauguggaggagugcucuuguuacccucgcuaucccgaagugagaugcgucugucgggacaacuggaagggcuccaaucgcccuguucuuuacaucaacauggcugauuauagcaucgagucuagcuacgugugcuccggccuggugggggacacacccagagaugacgacucuagcuccagcucuaauugucgggauccgaacaaugaacgcggagccccuggcgucaaagggugggcguuugacgauggaaacgacauuuggaugggcagaacgaucaaguccgauagccggucuggguacgagaccuuccgcgugguuaauggauggacaaccgccaacuccaaaagccagauuaauagacaggugaucgucgacuccgauucuuggagcggcuauuccggcaucuuuucuguggaagggaagaacugcauuaaucgguguuucuacguugagcucauuagaggacgcccccaagagacacgggugugguggaccagcaacuccaucaucgucuuuugcggcacgagcgggacauauggaaccggcucuuggccugacggggcuaauauuaacuucaugcccaucuga

SEQ ID NO: 206575 - RNA, 1401 nt, Artificial Sequence
  derived and/or modified sequence opt5 from neuraminidase__InfluenzaA__AGQ81763
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucguuccgugcgaacccaucauuaucgagcggaacacagugcaucucaauuccaccacaauugaacgcgagaucuguccuaaaguggcggaauacaagaacuggucuaaaccccagugccaaauuaccggguuugcuccuuucagcaaggacaauuccaucagacugucugccggaggcgauaucugggucacacgggagcccuaugugagcuguucccuugggaaaugcuaccaguuugcccugggacagggcaccacgcucaagaacaagcacagcaaugggaccacacaugaccgcaccccucacagaacacugcugaugaacgagcucggaguuccguuccaucugggcaccaaacagguguguauugcuuggucuuccagcucuugcuaugauggcaaggccuggcuucacaucugugucacgggggacgauaaaaaugcuacagccuccauuaucuacgacggaaugcugguggauagcauuggcucuugguccaagaacauccuccggacccaagaaagcgagugcguuuguaucaaugggacaugcgcgguggucaugaccgacggauccgccucuggcaaagcugauacccgcgugcuguuuauuagagaagggaagaucauuaacaucagcccccuuuccggaagcgcccagcacguggaggagugcucuuguuauccucgguaccccgaaguccgcugcguuuguagagacaacuggaagggcuccaaucggccugugcuguauauuaacauggcugauuacagcaucgagucuagcuacgugugcuccggccucgucggggacacaccccgcaaugaugacucuagcuccagcucuaacuguagagacccgaauaacgaacggggagccccuggcgugaaagggugggcguucgaugacggaaaugauguuuggaugggccgcacgaucaagaacggguccagaagcggauaugagaccuuucggguggucaauggcuggacaauggccaacucuaaaucccagauuaauagacaggugaucguugacagcgauaacugguccggcuacucugggauuuucagcguggaaggaaagaaaugcaucaaucgcuguuuuuaugucgagcugauucggggcagaccccaagagccucgcgugugguggaccuccaacucuaucauugucuucugcgggacaagcggaaccuacggcacgggguccuggcccgacggcgcuaauaucaacuuuaugcccaucuga

SEQ ID NO: 206576 - RNA, 1401 nt, Artificial Sequence
  derived and/or modified sequence opt5 from neuraminidase__InfluenzaA__AGQ81766
augaaccccaaucagaagaucauugccaucggcagcgugucccugaccauugcuaucauuugcuuccucaugcaaaucgccauccugacaacgaccaugacacuucacuuuagacagaacgaguguucuaauccuagcaacaaucaggucguuccgugcgaacccauuaucauugagcggaacaccgugcaucucaauuccacaaccaucgaaaaagagauuuguccuaagguggcggaauacaaaaacuggucuaagccccagugccaaaucacaggguucgcuccuuuuagcaaagacaauuccauucgccugucugccggaggcgauaucugggucaccagagagcccuaugugagcuguucccuggggaagugcuaccaguucgcccuuggacagggcacgacccugaagaacaaacacagcaaugggacaacccaugaccggaucccucaccgcacacuccugaugaacgagcugggaguuccguuucaucucggcaccaaacagguguguauugcuuggucuuccagcucuugccacgauggcaaggccuggcugcacaucugugucacgggggacgauaagaaugcuacagccuccauuaucuaugacggaaugcuuguggauagcauuggcucuugguccaaaaacauccugagaacccaagaaagcgagugcguuuguaucaaugggacaugcgcgguggucaugaccgacggauccgccucuggcaaggcugauacccggauucucuucauccgcgaagggaagauuaucaacauuagcccccuguccggaagcgcccagcauguggaggagugcucuuguuacccuagauaucccgaagugcggugcgucugucgcgacaacuggaaaggcuccaauagaccuguucuuuacaucaacauggcugauuauagcaucgagucuagcuacgugugcuccggccuggugggggacacaccccgggaugacgacucuuuuagcuccagcaauugucgcgauccgaacaaugaaagaggagccccuggcgucaaggggugggcguucgacgauggaaacgacauuuggaugggccggacgaucaaaucugauucccgcagcggguacgagaccuuuagagugguuaauggauggacaaccgccaacucuaagucccagauuaauagacaggugaucgucgacagcgauuccuggucuggcuauagcggcauuuucuccguggaagggaaaaacugcaucaaucgguguuuuuacguugagcucauucgcggacggccccaagagacaaucgugugguggaccucuaacagcaucauugucuucugcggcacguccgggacauauggaaccggcagcuggccugacggggcuaauaucaacuuuaugcccauuuga

SEQ ID NO: 206577 - RNA, 1401 nt, Artificial Sequence; identical to SEQ ID NO: 206576
  derived and/or modified sequence opt5 from neuraminidase__InfluenzaA__AGQ81767

SEQ ID NO: 206578 - RNA, 1410 nt, Artificial Sequence
  derived and/or modified sequence opt5 from neuraminidase__InfluenzaA__AGQ81768
augaaccccaaucagaagaucguggccauuggcagcgucucccugaccaucgcuacaauuugccuccugaugcaaaucgccauucuuguuacgaccaugacacugcacuucaaacauggggaguguaccaacucuagcaauaaccaggcggugccuugcggaccgaucaucauugaaagaaauaucacagagauugugcaccucaacuccaccacacuggaaaaggagaucugucccaaagcugccggcuaccgggacuggucuaagccucagugccagauuaccggguuugcccccuucagcaaagauaauuccauccgccuuucugcuagcggagacauuugggucacgagagaaccuuauguguccuguggccuggggaagugcuaccaauuugcccucggacagggcaccacacuggauaaccggcauagcaauggcaccucucacgaccgcacaccccauagaacccugcucauguccgagcuggggguuccuuuccaccuugcuacgaaacagguguguaucgccuggucuagcuccagcugccacgauggagaggcguggcugcauaucugugucacaggcgacgaucggaacgccaccgcuucuauuaucuaugacgggaugcucguggauuccauuggaagcugguccaagaauauccugcgcacacaggaaucugagugcguuuguauuaacgggaccugcaccguggucaugacagacggcagcgccuccggaaaggcugauacgagaauccuuuuuauccgggaaggcaaaauugugcacaucagcccgcugucuggcuccgcccaacauguggaggagugcagcuguuacccccaguauccugaaguccgcugcguuuguagagacaauuggcgggggucuaaccgccccgugcucuacauuaauauggcggauuauagcguggacuccggauacgucugcucuggccuggugggggacaccccuagaaacgaugacacaagcuccagcucuaacuguaaggaucccaauaacgagcggggagccccgggcguuaaagggugggcuuucgacuccggaaaugauaucuggaugggccgcaccauugaaaaggaccugagaagcggcuacgagacauuucgggugaucgggggauggaacaccgccaauucuaagucccagacgaacagacaggucaucguggauagcgacaauuccucuggcuauagcgggauuuucuccguugaaggaaaaucuugcaucaaccgcuguuuuuacguggagcucauucggggcagaccuaaggagacacgcgucugguggaccagcaauuccaucauuguguucugcgggaccagcggcacauauggaaccggcucuuggcccgauggggcuaacaucaauuuuaugccuauuuga

SEQ ID NO: 206579 - RNA, 1410 nt, Artificial Sequence
  derived and/or modified sequence opt5 from neuraminidase__InfluenzaA__AGQ81769
augaaccccaaucagaagaucguggccauuggcagcgucucccugaccaucgcuacaauuugccuccugaugcaaaucgccauucuuguuacgaccaugacacugcacuucaaacauggggaguguaccaacucuagcaauaaccaggcggugccuugcggaccgaucaucauugaaagaaauaucacagagauugugcaccucaacuccaccacacuggaaaaggagaucugucccaaagcugccggcuaccgggacuggucuaagccucagugccagauuaccggguuugcccccuucagcaaagauaauuccauccgccuuucugcuagcggagacauuugggucacgagagaaccuuauguguccuguggccuggggaagugcuaccaauuugcccucggacagggcaccacacuggauaaccggcauagcaauggcaccucucacgaccgcacaccccauagaacccugcucauguccgagcuggggguuccuuuccaccuugcuacgaaacagguguguaucgccuggucuagcuccagcugccacgauggagaggcguggcugcauaucugugucacaggcgacgaucggaacgccaccgcuucuauuaucuaugggggaaugcucguggacuccauuggcagcugguccaagaauauccugcgcacacaggaaucugagugcguuuguauuaacgggaccugcaccguggucaugacagauggaagcgccuccggcaaggcugacacgagaauccuuuuuauccgggaaggcaaaauugugcacaucagcccgcugucuggguccgcccaacauguggaggagugcagcuguuacccccaguauccugaaguccgcugcguuuguagagauaauuggcggggaucuaaccgccccgugcucuacauuaauauggcggacuauagcguggauuccggcuacgucugcucugggcuggugggagacaccccuagaaacgacgauacaagcuccagcucuaacuguaaggaccccaauaacgagcggggcgccccggggguuaaaggaugggcuuucgauuccggcaaugacaucuggaugggccgcaccauugaaaaggaucugagaagcggguacgagacauuucgggugaucggaggcuggaacaccgccaauucuaagucccagacgaacagacaggucaucguggacagcgauaauuccucuggguauagcggaauuuucuccguugaaggcaaaucuugcaucaaccgcuguuuuuacguggagcucauucgggggagaccuaaggagacacgcgucugguggaccagcaauuccaucauuguguucugcggcaccagcggaacauauggcaccgggucuuggcccgacggagcuaacaucaauuuuaugccuauuuga

SEQ ID NO: 206580 - RNA, 1401 nt, Artificial Sequence
  derived and/or modified sequence opt5 from neuraminidase__InfluenzaA__AGQ81770
augaaccccaaucagaagaucauugccaucggcagcguguccauuaccaucgcuauuaucugcuucaucaugcaaauugccauccugacaacgaccaugacacuccacuuuagacagaacgaguguucuaauccuagcaacaaucaggucguuccgugcgaacccauuaucauugagcggaacaccgugcaucuuaauuccacaaccaucgaaaaagagacauguccuaagguggcggaauacaaaaacuggucuaagccccagugccaaauuaccggguucgcuccuuuuagcaaagacaauuccauccgccugucugccggaggcgauaucugggucacgagagagcccuaugugagcuguucccuggggaagugcuaccaguucgcccucggacagggcaccacacugaagaacaaacacagcaaugggaccacacaugaccggauuccucaccgcacccuucugaugaacgagcucggaguuccguuucaucugggcacgaaacagguguguaucgcuuggucuuccagcucuugccacgauggcaaggccuggcugcacauuugugucacaggggacgauaagaaugcuaccgccuccaucauuuaugacggaaugcucguggauagcaucggcucuugguccaaaaacauccugagaacacaagaaagcgagugcguuuguauuaaugggaccugcgcgguggucaugaccgacggauccgccucuggcaaggcugauacacgggugcuuuucauccgcgaagggaagauuaucaacauuagcccccuguccggaagcgcccagcauguggaggagugcucuuguuacccuagauaucccgaaguccggugcguuugucgcgacaacuggaaaggcuccaauagaccugugcucuacaucaacauggcugauuauagcguggagucuagcuacgucugcuccggccuggugggggacacgccccgggaugacgacucuagcuccagcucuaauugucgcgauccgaacaaugaaagaggagccccuggcguuaaggggugggcguuugacgauggaaacgacaucuggaugggccggaccauuaaauccgauagccgcucuggguacgagacauucagaguggucaauggauggaccacagccaacuccaagagccagaucaauagacaggugauuguugacuccgauucuuggagcggcuauuccggcaucuuuucuguggaagggaaaaacugcauuaaucgguguuucuacgucgagcuuauccgcggacggccccaagagaccagagugugguggacgagcaacuccauuaucgucuuuugcggcacaagcgggaccuauggaaccggcucuuggccugacggggcuaauaucaacuucaugcccauuuga

SEQ ID NO: 206581 - RNA, 1410 nt, Artificial Sequence
  derived and/or modified sequence opt5 from neuraminidase__InfluenzaA__AGQ81772
augaaccccaaucagaagaucguggccauuggcagcgcuucccugaccaucgccacaaugugccuccugcuucaaauugcgcuguucgcuacgaccaugacacuccacuuuaaacagaccggguguacaaacucuagcgacaaucaggccgucccuugcggaccgaucauuaucgagagaaacaucaccgaaauuguucaucuuaauuccacaacccuggagaaggaaacgugucccaaaucugccggcuaccggaacuggagcaagccucagugccaaaucaccggguucgcucccuuuuccaaagauaauucuauucgccuggccgcugccggagacaucugggugacaagagagccuuaugugagcuguggccucgggaagugcuaccaguucgcgcugggacagggcaccacacuggauaacaagcacuccaauggcaccacgcaugaccggacaccccaccgcacccuccugaugagcgaacuuggggucccuuuucaucuggccacaaaacagguguguauugcuuggucuuccagcucuugccacgauggaaaggccuggcuccacguuugugugaccggcgacgauaaaaacgcuaccgccuccaucauuuaugacgggauccuggucgauagcaucgcgucuugguccaagaauauucuuagaacacaagagagcgagugcguguguaucaacggaacgugcaccguugugaugacagacggcuccgccucugggcgggcugauacccgcauucuguucaucagagaaggaaaaauuguccauaucagcccgcucuccggcagcgcccagcacguggaggaaugcucuuguuacccccgguauccugaggugcgcugcgucuguagagacaauuggaagggcuccaaccggcccguucuguuuaucaauauggcugauuacagcauugacucuagcuaugugugcccugggcuggugggagacacaccccgcaacgaugacagauccucuagcuccaacugucgggauccgaauaacgagcgcggcgccccuggggucaagggaugggccuucgacagcggcaaugauaucuggauggggagaaccauugaaaaagacucucgguccggauacgagacguuuagagugaucagcggcuggucuacagcuaacuccaagagccagauuaaucgccagguuaucguggaucgggacaacuccucuggcuacagcgggaucuucuccgucgaaggaaaaucuugcauuaauagauguuuuuauguggagcucauccgcggccggcccaaggaaaacagaguuugguggaccagcaauuccauuaucguguucugcgggaccagcggaacauacggcaccgggucuuggccugauggcgcgaacauuaaucugaugcccaucuga

SEQ ID NO: 206582 - RNA, 1401 nt, Artificial Sequence
  derived and/or modified sequence opt5 from neuraminidase__InfluenzaA__AGQ81773
augaaccccaaucagaagaucauugccaucggcagcgugucccugaccauugcuaucauuugcuuccucaugcaaaucgccauccugacaacgaccaugacacuucacuuuagacagaacgaguguucuaauccuagcaacaaucaggucguuccgugcgaacccauuaucauugagcggaaaaccgugcaucugaacuccacaaccaucgaaaaggagauuuguccuaaaguggcggaauacaagaauuggucuaaaccccagugccaaaucacaggguucgcuccuuuuagcaaggacaacuccauucgccucucugccggaggcgauaucugggucaccagagagcccuaugugagcuguucccuggggaagugcuaccaguucgcccuuggacagggcacgacccugaaaaauaagcacagcaacgggacaacccaugaccggaucccucaccgcacacuccugaugaaugagcugggaguuccgcuccauuggggcaccaaacagguguguauugcuuggucuuccagcucuugccacgauggcaaggccuggcugcacaucugugucacgggggacgauaaaaacgcuacagccuccauuaucuaugacggaaugcuuguggauagcauuggcucuugguccaagaauauccugagaacccaagaaagcgagugcguuuguaucaacgggacaugcgcgguggucaugaccgacggauccgccucuggcaaggcugauacccgggugcucuuuauucgcgaagggaaaaucauuaauaucagcccccuguccggaagcgcccagcauguggaggagugcucuuguuacccuagauaucccgaaguccggugcguuugucgcgacaacuggaagggcuccaacagaccugugcuuuacauuaauauggcugauuauagcaucgagucuagcuacgugugcuccggccuggucggggacacaccccgggaugacgacucuagcuccagcucuaacugucgcgauccgaauaacgaaagaggagccccuggcgugaaaggguggggauucgacgauggcaaugacaucuggauggggcggacgauuaaguccgauagccgcucuggauacgagaccuuuagaguugugaacggcuggacaaccgccaauuccaaaagccagaucaaccggcaggucauuguggacuccgauucuuggagcggcuauuccgggaucuucucuguugaaggaaagaauugcauuaacagauguuuuuacguggagcucauccgcggccggccccaagagacaagagucugguggaccagcaauuccauuaucguguucugcgggacgagcggaacauauggcaccgggucuuggccugacggcgcgaacaucaauuuuaugcccauuuga

SEQ ID NO: 206583 - RNA, 1401 nt, Artificial Sequence
  derived and/or modified sequence opt5 from neuraminidase__InfluenzaA__AGQ81774
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauuaucgagcggaacacaguucaucucaauuccaccacaauugaacgcgagaucuguccuaaaguggcggaauacaagaacuggucuaaaccccagugccaaauuaccggguuugcuccuuucagcaaggacaauuccaucagacugucugccggaggcgauaucugggugacacgggagcccuaugucagcuguucccuugacaaaugcuaccaguuugcccuggggcagggaaccacgcucaagaacaagcacagcaauggcaccacacaugaucgcaccccucacagaacacugcugaugaacgagcucggggugccguuccaucugggaaccaaacagguuuguauugcuuggucuuccagcucuugcuaugacggcaaggccuggcuucacaucugugugacgggcgaugacaaaaaugcuacagccuccauuaucuacgaugggaugcuggucgacagcauuggaucuugguccaagaacauccuccggacccaagaaagcgagugcguguguaucaauggcacaugcgcgguugugaugaccgauggguccgccucuggaaaagcugacacccgcguccuguuuauuagagaaggcaagaucauuaacaucagcccccuuuccgggagcgcccagcacguggaggagugcucuuguuauccucgguaccccgaagugcgcugcgucuguagagauaacuggaagggauccaaucggccuauucuguauaucaacauggcugacuacagcaucgagucuagcuacguuugcuccggccucgugggcgauacaccccgcaaugacgacucuagcuccagcucuaacuguagagauccgaauaacgaacgcggggccccuggagugaaaggcugggcguucgacgaugggaaugacgucuggaugggacggacgauuaagaacggcuccagaagcggguaugagaccuuucgggugguuaauggauggacaaucgccaacucuaaaucccagauuaauagacaggugaucgucgauagcgacgauugguccggcuacucuggcauuuucagcguggaagggaagaaaugcaucaaccgcuguuuuuauguugagcugauucggggaagaccccaagagccucgcgugugguggaccuccaauucuaucaucgucuucugcggcacaagcgggaccuacggaacgggcuccuggcccgacggggcuaacauuaauuuuaugcccaucuga

SEQ ID NO: 206584 - RNA, 1401 nt, Artificial Sequence
  derived and/or modified sequence opt5 from neuraminidase__InfluenzaA__AGQ81776
augaaccccaaucagaagaucauugccaucggcagcgugucccugaccauugcuaucauuugcuuccucaugcaaaucgccauccugacaacgaccaugacacuucacuuuagacagaacgaguguucuaauccuagcaacaaucaggucguuccgugcgaacccauuaucauugagcggaacaccgugcaucucaauuccacaaccaucgaaaaagagauuuguccuaagguggcggaauacaaaaacuggucuaagccccagugccaaaucacaggguucgcuccuuuuagcaaagacaauuccauucgccucucugccggaggcgauaucugggucaccagagagcccuaugugagcuguucccuggggaagugcuaccaguucgcccuuggacagggcacgacccugaagaacaaacacagcaaugggacaacccaugaccggaucccucaccgcacacuccugaugaacgagcugggaguuccguuucaucucggcaccaaacagguguguauugcuuggucuuccagcucuugccacgauggcaaggccuggcugcacaucugugucacgggggacgauaagaaugcuacagccuccauuaucuaugacggaaugcuuguggauagcauuggcucuugguccaaaaacauccugagaacccaagaaagcgagugcguuuguaucaaugggacaugcgcgguggucaugaccgacggauccgccucuggcaaggcugauacccgggugcuguucauucgcgaagggaagaucauuaacaucagcccccuguccggaagcgcccagcauguggaggagugcucuuguuacccuagauaucccgaaguccggugcguuugucgcgacaacuggaaaggcuccaauagaccugugcuuuacauuaacauggcugauuauagcaucgagucuagcuacgugugcuccggccuggucggggacacaccccgggaugacgacucuagcuccagcucuaauugucgcgauccgaacaaugaaagaggagccccuggcgugaaggggugggcguuugacgauggaaacgacaucuggaugggccggacgauuaaauccgauagccgcucuggguacgagaccuucagaguuaucgacggauggacaaccgccgauuccaagagccagauuaauagacaggugaucgucgacuccgauucuuggagcggcuauuccggcaucuuuucuguggaagggaaaaacugcauuaaucgguguuucuacguugagcucauucgcggacggccccaagagacaagagugugguggaccagcaacuccaucaucgucuuuugcggcacgagcgggacauauggaaccggcucuuggccugacggggcuaauauuaacuucaugcccaucuga

SEQ ID NO: 206585 - RNA, 1410 nt, Artificial Sequence
  derived and/or modified sequence opt5 from neuraminidase__InfluenzaA__AGQ81777
augaaccccaaucagaagaucgugaccauuggcagcgccucccugacaaucgcuacgaugugccuccugcuucaaauugcccuguucgcgaccacaaugacccuccacuuuaaacagacaggguguaccaacucuagcgacaaucaggcugucccuugcggaccgaucauuaucgagagaaacaucacagaaauuguucaucugaauagcaccacgcuugagaaggaaaccugucccaaaucugccggcuaccggaacuggagcaagccucagugccaaaucacaggguucgcccccuuuuccaaagauaauucuauucgccuggcugccgcuggagacaucugggugaccagagagccuuaugugagcuguggccucgggaagugcuaccaguucgcccugggacagggcacaacccuggauaacaagcacuccaauggcacgacacaugaccggacaccccaccgcacccuccugaugaacgaacuuggggucccuuuucaucuggcgaccaaacagguguguauugccugguccucuuccagcugccacgauggaaaggcuuggcuccacguuugugugaccggcgacgauaaaaaugccacagcuucuaucauuuaugacgggauccuggucgauuccaucgccagcuggucuaagaacauucuuagaacgcaagaguccgagugcguguguaucaauggaaccugcacaguugugaugaccgacggcagcgcguccgggcgggccgauacacgcauucuguucaucagagaaggaaaaauuguccauaucucuccgcucagcggcuccgcucagcacguggaggaaugcagcuguuacccccgguauccugaggugcgcugcgucuguagagacaacuggaauggcucuaaccggcccguucuguuuaucaacauggccgauuacuccauugacagcucuuaugugugcagcgggcuggugggagacaccccucgcaaugaugacagauccucuagcuccaacugucgggaucccaauaacgagcgcggcgcuccgggggucaagggaugggccuucgacagcggcaaugauaucuggauggggagaacgauugaaaaggacucucgguccggauacgagacauuuagagugaucagcggcuggucuaccgccaacuccaaaagccagauuaaucgccagguuaucguggaucgggacaacuccucuggcuacagcgggaucuucuccgucgaaggaaagucuugcauuaauagauguuuuuauguggagcucauccgcggccggccuaaagaaaacagaguuugguggaccagcaauuccauuaucguguucugcgggacaagcggaaccuacggcacagggucuuggcccgauggcgcuaacauuaaucugaugccuaucuga

SEQ ID NO: 206586 - RNA, 1410 nt, Artificial Sequence
  derived and/or modified sequence opt5 from neuraminidase__InfluenzaA__AGQ81778
augaaccccaaucagaagaucgugaccauuggcagcgccucccugacaaucgcuacgaugugccuccugcuucaaauugcccuguucgcgaccacaaugacccuccacuuuaaacagacaggguguaccaacucuagcgacaaucaggcugucccuugcggaccgaucauuaucgagagaaacaucacagaaauuguucaucugaauagcaccacgcuugagaaggaaaccugucccaaaucugccggcuaccggaacuggagcaagccucagugccaaaucacaggguucgcccccuuuuccaaagauaauucuauucgccuggcugccgcuggagacaucugggugaccagagagccuuaugugagcuguggccucgggaagugcuaccaguucgcccugggacagggcacaacccuggauaacaagcacuccaauggcacgacacaugaccggacaccccaccgcacccuccugaugaacgaacuuggggucccuuuucaucuggcgaccaaacagguguguauugccugguccucuuccagcugccacgauggaaaggcuuggcuccacguuugugugaccggcgacgauaaaaaugccacagcuucuaucauuuaugacgggauccuggucgauuccaucgccagcuggucuaagaacauucuuagaacgcaagaguccgagugcguguguaucaauggaaccugcacaguugugaugaccgacggcagcgcguccgggcgggccgauacacgcauucuguucaucagagaaggaaaaauuguccauaucucuccgcucagcggcuccgcucagcacguggaggaaugcagcuguuacccccgguauccugaggugcgcugcgucuguagagacaacuggaagggcucuaaucggcccguucuguuuaucaacauggccgauuacuccauugacagcucuuaugugugcagcgggcuggugggagacaccccucgcaacgaugacagauccucuagcuccaauugucgggaucccaacaaugagcgcggcgcuccgggggucaagggaugggccuucgacagcggcaacgauaucuggauggggagaacgauugaaaaagacucucgguccggauacgagacauuuagagugaucagcggcuggucuaccgccaauuccaagagccagauuaaccgccagguuaucguggaucgggacaauuccucuggcuacagcgggaucuucuccgucgaaggaaaaucuugcauuaacagauguuuuuauguggagcucauccgcggccggccuaaggaaaauagaguuugguggaccagcaacuccauuaucguguucugcgggacaagcggaaccuacggcacagggucuuggcccgauggcgcuaauauuaaccugaugccuaucuga

SEQ ID NO: 206587 - RNA, 1410 nt, Artificial Sequence
  derived and/or modified sequence opt5 from neuraminidase__InfluenzaA__AGQ81779
augaaccccaaucagaagaucguggccauuggcagcgcuucccugaccaucgccacaaugugccuccugcuucaaauugcgcuguucgcuacgaccaugacacuccacuuuaaacagaccggguguacaaacucuagcgacaaucaggccgucccuugcggaccgaucauuaucgagagaaacaucaccgaaauuguucaucugaauagcacaacccuugagaaggaaacgugucccaaaucugccggcuaccggaacuggagcaagccucagugccaaaucaccggguucgcucccuuuuccaaagauaauucuauucgccuggccgcugccggagacaucugggugacaagagagccuuaugugagcuguggccucgggaagugcuaccaguucgcgcugggacagggcaccacacuggauaacaagcacuccaauggcaccacgcaugaccggacaccccaccgcacccuccugaugaacgaacuuggggucccuuuucaucuggccacaaaacagguguguauugcuugguccucuuccagcugccacgauggaaaggccuggcuccacguuugugugaccggcgacgauaaaaaugcuaccgccucuaucauuuaugacgggauccuggucgauuccaucgcgagcuggucuaagaacauucuuagaacacaagaguccgagugcguguguaucaauggaacgugcaccguugugaugacagacggcagcgccuccgggcgggcugauacccgcauucuguucaucagagaaggaaaaauuguccauaucucuccgcucagcggcuccgcccagcacguggaggaaugcagcuguuacccccgguauccugagauccgcugcguguguagagacaacuggaagggcucuaaucggcccguccuguuuauuaacauggcugauuacuccaucgacagcucuuauguuugcagcgggcuggugggagacacaccucgcaacgaugacagauccucuagcuccaauugucgggaucccaacaaugagcgcggcgccccgggggugaagggaugggccuucgacagcggcaacgauauuuggauggggagaaccaucgaaaaagacucucgguccggauacgagacguuuagagucauuagcggcuggucuacagcuaauuccaagagccagaucaaccgccaggugaucguugaucgggacaauuccucuggcuacagcgggauuuucuccguggaaggaaaaucuugcaucaacagauguuuuuaugucgagcucauucgcggccggccuaaggaaaauagagugugguggaccagcaacuccaucauuguuuucugcgggaccagcggaacauacggcaccgggucuuggcccgauggcgcgaauaucaaccugaugccuauuuga

SEQ ID NO: 206588 - RNA, 1410 nt, Artificial Sequence
  derived and/or modified sequence opt5 from neuraminidase__InfluenzaA__AGQ81780
augaaccccaaucagaagaucguggccauuggcagcgcuucccugaccaucgccacaaugugccuccugcuucaaauugcgcuguucgcuacgaccaugacacuccacuuuaaacagaccggguguacaaacucuagcgacaaucaggccgucccuugcggaccgaucauuaucgagagaaacaucaccgaaauuguucaucugaauagcacaacccuugagaaggaaacgugucccaaaucugccggcuaccggaacuggagcaagccucagugccaaaucaccggguucgcucccuuuuccaaagauaauucuauucgccuggccgcugccggagacaucugggugacaagagagccuuaugugagcuguggccucgggaagugcuaccaguucgcgcugggacagggcaccacacuggauaacaagcacuccaauggcaccacgcaugaccggacaccccaccgcacccuccugaugaacgaacuuggggucccuuuucaucuggccacaaaacagguguguauugcuugguccucuuccagcugccacgauggaaaggccuggcuccacguuugugugaccggcgacgauaaaaaugcuaccgccucuaucauuuaugacgggauccuggucgauuccaucgcgagcuggucuaagaacauucuuagaacacaagaguccgagugcguguguaucaauggaacgugcaccguugugaugacagacggcagcgccuccgggcgggcugauacccgcauucuguucaucagagaaggaaaaauuguccauaucucuccgcucagcggcuccgcccagcacguggaggaaugcagcuguuacccccgguauccugaggugcgcugcgucuguagagacaacuggaagggcucuaaucggcccguucuguuuaucaacauggcugauuacuccauugacagcucuuaugugugcagcgggcuggugggagacacaccucgcaacgaugacagauccucuagcuccaauugucgggaucccaacaaugagcgcggcgccagcggggucaagggaugggccuucgacucuggcaacgauaucuggauggggagaaccauugaaaaagacucccggagcggauacgagacguuuagagugaucucuggcugguccacagcuaauagcaagucccagauuaaccgccagguuaucguggaucgggacaauucuagcggcuacuccgggaucuucucugucgaaggaaaaagcugcauuaacagauguuuuuauguggagcucauccgcggccggccgaaggaaaauagaguuugguggaccuccaacagcauuaucguguucugcgggaccucuggaacauacggcaccggguccuggccugauggcgcgaauauuaaccugaugcccaucuga

SEQ ID NO: 206589 - RNA, 1401 nt, Artificial Sequence
  derived and/or modified sequence opt5 from neuraminidase__InfluenzaA__AGQ81781
augaaccccaaucagaagaucauugccaucggcagcgugucccugaccauugcuaucauuugcuuccucaugcaaaucgccauccugacaacgaccaugacaccucacuuuagacagaacgaguguucuaauccgagcaacaaucaggucguucccugcgaaccuauuaucauugagcggaacaccgugcaucuuaauuccacaaccaucgaaaaagagauuugucccaagguggcggaauacaaaaacuggucuaagccucagugccaaaucacaggguucgcucccuuuagcaaagacaauuccauucgccugucugccggaggcgauaucugggucaccagagagccuuaugugagcuguucccucgggaagugcuaccaguucgcccugggacagggcacgacccuuaagaacaaacacagcaaugggacaacccaugaccggaucccgcaccgcacacugcucaugaacgagcugggaguucccuuucaucugggcaccaaacagguguguauugcuuggucuuccagcucuugccacgauggcaaggccuggcuccacaucugugucacgggggacgauaagaaugcuacagccuccauuaucuaugacggaaugcugguggauagcauuggcucuugguccaaaaacauccuuagaacccaagaaagcgagugcguuuguaucaaugggacaugcgcgguggucaugaccgacggauccgccucuggcaaggcugauacccggauucuguucauccgcgaagggaagauuaucaacauuagcccucucuccggaagcgcccagcauguggaggagugcucuuguuaccccagauauccugaagugcggugcgucugucgcgacaacuggaaaggcuccaauagacccguucuguacaucaacauggcugauuauagcaucgagucuagcuacgugugcuccggccuugugggggacacaccgcgggaugacgacucuagcuccagcucuaauugucgcgauccuaacaaugaaagaggagcccccggcgucaaggggugggcguuugacgauggaaacgacauuuggaugggccggacgaucaaauccgauagccgcucuggguacgagaccuucagagugguuaauggauggacaaccgccaacuccaagagccagauuaauagacaggugaucgucgacuccgauucuuggagcggcuauuccggcaucuuuucuguggaagggaaaaacugcauuaaucgguguuucuacguugagcugauucgcggacggccucaagagacaagagugugguggaccagcaacuccaucaucgucuuuugcggcacgagcgggacauauggaaccggcucuuggcccgacggggcugauauuaaucucaugcccaucuga

SEQ ID NO: 206590 - RNA, 1410 nt, Artificial Sequence
  derived and/or modified sequence opt5 from neuraminidase__InfluenzaA__AGQ81783
augaaccccaaucagaagaucgugaccauuggcagcgccucccugacaaucgcuacgaugugccuccugcuucaaauugcccuguucgcgaccacaaugacccuccacuuuaaacagacaggguguaccaacucuagcgacaaucaggcugucccuugcggaccgaucauuaucgagagaaacaucacagaaauuguucaucugaauagcaccacgcuugagaaggaaaccugucccaaaucugccggcuaccggaacuggagcaagccucagugccaaaucacaggguucgcccccuuuuccaaagauaauucuauucgccuggcugccgcuggagacaucugggugaccagagagccuuaugugagcuguggccucgggaagugcuaccaguucgcccugggacagggcacaacccuggauaacaagcacuccaauggcacgacacaugaccggacaccccaccgcacccuccugaugaacgaacuuggggucccuuuucaucuggcgaccaaacagguguguauugccugguccucuuccagcugccacgauggaaaggcuuggcuccacguuugugugaccggcgacgauaaaaaugccacagcuucuaucauuuauaacgggauccuggucgacuccaucgccagcuggucuaagaauauucuuagaacgcaagaguccgagugcguguguaucaacggaaccugcacaguugugaugaccgauggcagcgcguccgggcgggccgacacacgcauucuguucaucagagaaggaaaaauuguccauaucucuccgcucagcggcuccgcucagcacguggaggaaugcagcuguuacccccgguauccugaggugcgcugcgucuguagagauaauuggaagggcucuaaccggcccguucuguuuaucaacauggccgacuacuccauugauagcucuuaugugugcagcgggcuggugggagacaccccucgcaaugacgauagauccucuagcuccaacugucgggaccccaauaacgagcgcggcgcuccgggggucaagggaugggccuucgauagcggcaaugacaucuggauggggagaacgauugaaaaagauucucgguccggauacgagacauuuagagugaucagcggcuggucuaccgccaacuccaagagccagauuaaucgccagguuaucguggaccgggauaacuccucuggcuacagcgggaucuucuccgucgaaggaaaaucuugcauuaauagauguuuuuauguggagcucauccgcggccggccuaaggaaaacagaguuugguggaccagcaauuccauuaucguguucugcgggacaagcggaaccuacggcacagggucuuggcccgacggcgcuaacauuaaucugaugccuaucuga

SEQ ID NO: 206591 - RNA, 1401 nt, Artificial Sequence
  derived and/or modified sequence opt5 from neuraminidase__InfluenzaA__AGQ81784
augaaccccaaucagaagaucauugccaucggcagcgugucccugaccauugcuaucauuugcuuccucaugcaaaucgccauccugacaacgaccaugacacuucacuuuagacagaacgaguguucuaauccuagcaacaaucaggucguuccgugcgaacccauuaucauugagcggaacaccgugcaucucaauuccacaaccaucgaaaaagagauuuguccuaagguggcggaauacaaaaacuggucuaagccccagugccaaaucacaggguucgcuccuuuuagcaaagacaauuccauucgccucucugccggaggcgauaucugggucaccagagagcccuaugugagcuguucccuggggaagugcuaccaguucgcccuuggacagggcacgacccugcggaacaagcacagcaaugggacaacccaugaccgcaucccucacagaacacuccugaugaacgagcugggaguuccguuucaucucggcaccaaacagguguguauugcuuggucuuccagcucuugccacgauggcaaggccuggcugcacaucugugucacgggggacgauaaaaaugcuacagccuccauuaucuaugacggaaugcuuguggauagcauuggcucuugguccaagaacauccugcggacccaagaaagcgagugcguuuguaucaaugggacaugcgcgguggucaugaccgacggaaacgccuccggcaaagcugauacccgcgugcuguucauuagagaagggaagaucauuaacaucucuccccugagcggauccgcccagcauguggaggagugcagcuguuacccucgguaucccgaaguccgcugcguuuguagagacaauuggaagggcucuaaccggccugugcuuuacauuaauauggcugauuauuccaucgagagcucuuacgugugcagcggccuggucggggacacaccccgcgaugacgacuccucuagcuccagcaacuguagagauccgaauaacgaacggggagccccuggcgugaaagggugggcguuugacgauggaaaugacaucuggaugggccgcacgauuaagucugauuccagaagcggguacgagaccuuccggguugugaacggauggacaaccgccaauucuaaaucccagaucaacagacaggucauuguggacagcgauuccuggucuggcuauagcggcaucuuuuccguugaagggaagaauugcauuaaccgcuguuucuacguggagcucauccggggaagaccccaagagacacgcgucugguggaccucuaauagcauuaucguguuuugcggcacguccgggacauauggaaccggcagcuggccugacggggcugauaucaacuucaugcccauuuga

SEQ ID NO: 206592 - RNA, 1401 nt, Artificial Sequence
  derived and/or modified sequence opt5 from neuraminidase__InfluenzaA__AGQ81785
augaaccccaaucagaagaucauugccaucggcagcgugucccugaccauugcuaucauuugcuucaucaugcaaaucgccauucucacaacgaccaugacaccucacuuuagacagaacgaguguucuaauccgagcaacaaucaggucguucccugcgaaccuaucauuaucgagcggaacaccgugcaucuuaauuccacaaccauugaaaaagagaucugucccaagguggcggaauacaaaaacuggucuaagccucagugccaaauuacaggguucgcucccuuuagcaaagacaauuccauccgccugucugccggaggcgauaucugggucaccagagagccuuaugugagcuguucccuggggaagugcuaccaguucgcccucggacagggcacgacccugaagaacaaacacagcaaugggacaacccaugaccggauuccgcaccgcacacuucugaugaacgagcucggaguucccuuucaucugggcaccaaacagguguguaucgcuuggucuuccagcucuugccacgauggcaaggccuggcugcacauuugugucacgggggacgauaagaaugcuacagccuccaucauuuaugacggaaugcucguggauagcaucggcucuugguccaaaaacauccugagaacccaagaaagcgagugcguuuguauuaaugggacaugcgcgguggucaugaccgacggauccgccucuggcaaggcugauacccggauccuuuucauucgcgaagggaagaucauuaacaucagcccucuguccggaagcgcccagcauguggaggagugcucuuguuaccccagauauccugaagugcggugcgucugucgcgacaacuggaaaggcuccaauagacccguucucuacaucaacauggcugauuauagcauugagucuagcuacgugugcuccggccuggugggggacacaccgcgggaugacgacucuagcuccagcucuaauugucgcgauccuaacaaugaaagaggagcccccggcgucaaggggugggcguuugacgauggaaacgacaucuggaugggccggacgauuaaauccgauagccgcucuggguacgagaccuucagagugguuaauggauggacaaccgccaacuccaagagccagaucaauagacaggugauugucgacuccgauucuuggagcggcuauuccggcaucuuuucuguggaagggaaaaacugcauuaaucgguguuucuacguugagcuuauccgcggacggccucaagagacaagagugugguggaccagcaacuccaucauugucuuuugcggcacgagcgggacauauggaaccggcucuuggcccgacggggcugauaucaaucugaugcccauuuga

SEQ ID NO: 206593 - RNA, 1401 nt, Artificial Sequence
  derived and/or modified sequence opt5 from neuraminidase__InfluenzaA__AGQ81787
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucguuccgugcgaacccaucauuaucgagcggaacacagugcaucucaauuccaccacaauugaacgcgagaucuguccuaaaguggcggaauacaagaacuggucuaaaccccagugccaaauuaccggguuugcuccuuucagcaaggacaauuccaucagacugucugccggaggcgauaucugggucacacgggagcccuaugugagcuguucccuugacaaaugcuaccaguuugcccuggggcagggaaccacgcucaagaacaagcacagcaauggcaccacacaugaucgcaccccucacagaacacugcugaugaacgagcucgggguuccguuccaucugggaaccaaacagguguguauugcuuggucuuccagcucuugcuaugacggcaaggccuggcuucacaucugugucacgggcgaugacaaaaaugcuacagccuccauuaucuacgaugggaugcugguggacagcauuggaucuugguccaagaacauccuccggacccaagaaagcgagugcguuuguaucaauggcacaugcgcgguggucaugaccgauggguccgccucuggaaaagcugacacccgcgugcuguuuauuagagaaggcaagaucauuaacaucagcccccuuuccgggagcgcccagcacguggaggagugcucuuguuauccucgguaccccgaaguccgcugcguuuguagagauaacuggaagggauccaaucggccuauucuguauaucaacauggcugacuacagcaucgagucuagcuacgugugcuccggccucgugggcgauacaccccgcaaugacgacucuagcuccagcucuaacuguagagauccgaauaacgaacgcggggccccuggagucaaaggcugggcguucgacgaugggaaugacguguggaugggacggacgauuaagaacggcuccagaagcggguaugagaccuuucggguugugaauggauggacaauggccaacucuaaaucccagaucaauagacaggucauuguggauagcgacgauugguccggcuacucuggcaucuucagcguugaagggaagaaaugcauuaaccgcuguuuuuauguggagcugauccggggaagaccccaagagccucgcgucugguggaccuccaauucuauuaucguguucugcggcacaagcgggaccuacggaacgggcuccuggcccgacggggcuaacaucaauuuuaugcccauuuga

SEQ ID NO: 206594 - RNA, 1401 nt, Artificial Sequence
  derived and/or modified sequence opt5 from neuraminidase__InfluenzaA__AGQ81789
augaaccccaaucagaagaucauugccaucggcagcgugucccugaccauugcuaucauuugccuccugaugcaaaucgccauccuuacaacgaccaugacaccucacuucagacagaacgaguguucuaauccgagcaacaaucaggucguucccugcgaaccuauuaucauugagcggaacaccgugcaucucaauuccacaaccaucgaaaaagagauuugucccaagguggcggaauacaaaaacuggucuaagccucagugccaaaucacaggguuugcucccuucagcaaagacaauuccauucgccugucugccggaggcgauaucugggucaccagagagccuuaugugagcuguucccuggggaagugcuaccaguuugcccuuggacagggcacgacccugaagaacaaacacagcaaugggacaacccaugaccggaucccgcaccgcacacuccugaugaacgagcugggaguucccuuccaucucggcaccaaacagguguguauugcuuggucuuccagcucuugccacgauggcaaggccuggcugcacaucugugucacgggggacgauaagaaugcuacagccuccauuaucuaugacggaaugcuuguggauagcauuggcucuugguccaaaaacauccugagaacccaagaaagcgagugcguuuguaucaaugggacaugcgcgguggucaugaccgacggauccgccucuggcaaggcugauacccggauucucuuuauccgcgaagggaagauuaucaacauuagcccucuguccggaagcgcccagcauguggaggagugcucuuguuaccccagauauccugaagugcggugcgucugucgcgacaacuggaaaggcuccaauagacccguucuuuacaucaacauggcugauuauagcaucgagucuagcuacgugugcuccggccuggugggggacacaccgcgggaugacgacucuagcuccagcucuaauugucgcgauccuaacaaugaaagaggagcccccggcgucaaggggugggcguucgacgauggaaacgacauuuggaugggccggacgaucaaauccgauagccgcucuggguacgagaccuuuagagugguuaauggauggacaaccgccaacuccaagagccagauuaauagacaggugaucgucgacuccgauucuuggagcggcuauuccggcauuuucucuguggaagggaaaaacugcaucaaucgguguuuuuacguugagcucauucgcggacggccucaagagacaagagugugguggaccagcaacuccaucaucgucuucugcggcacgagcgggacauauggaaccggcucuuggcccgacggggcugauauuaaucugaugcccaucuga

SEQ ID NO: 206595 - RNA, 1401 nt, Artificial Sequence
  derived and/or modified sequence opt5 from neuraminidase__InfluenzaA__AGQ81790
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggcgaugccgugcgaacccaucauuaucgagcggaacacaguccaucucaauuccaccacaauugaacgcgagaucuguccuaaaguuaccgaauacaagaacuggucuaaaccccagugccaaauuacaggguuugcuccuuucagcaaggacaauuccaucagacugucugccggaggcgauaucugggugacccgggagcccuaugugagcuguucccuugacaaaugcuaccaguuugcccuggggcagggaacgacccucaagaacaagcacagcaauggcacaacccaugaucgcacaccucacagaacccugcugaugaacgagcucggggucccguuccaucugggaacgaaacagguguguauugcuuggucuuccagcucuugcuaugacggcaaggccuggcuucacaucuguguuacaggcgaugacaaaaaugcuaccgccuccauuaucuacgaugggaugcugguggacagcauuggaucuugguccaagaacauccuccggacacaagaaagcgagugcgucuguaucaaugggaccugcgcggugguuaugaccgauggcuccgccucuggacgcgcugacacaagagugcuguuuauucgggaaggcaaaaucauuaacaucagcccccuuuccgggaacgcccagcacgucgaggagugcagcuguuauccucgcuaccccgaagugagaugcgugugucgggauaauuggaagggaucuaaccgcccuauucuguauaucaauauggcugacuacuccaucgagagcucuuacgucugcagcggccucguuggcgauacgcccagaaacgacgacuccucuagcuccagcaauugucgggauccgaacaaugaacgcggggccccuggagugaagggcugggcguucgacgaugggaacgacguguggaugggaagaaccauuaaaaauggcucucgguccggguaugagacauuuagagucgugaacggauggaccauggccaauagcaagucucagaucaaccgccagguuauuguggauuccgacgaauggagcggcuacuccggcaucuucucugucgaggggaaaaagugcauuaaucgguguuuuuauguggagcugaucagaggacgcccccaagaaccucggguuugguggacaagcaacuccauuaucguguucugcggcaccucugggacguacggaacaggcagcuggcccgauggggcuaauaucaacuuuaugcccauuuga

SEQ ID NO: 206596 - RNA, 1401 nt, Artificial Sequence
  derived and/or modified sequence opt5 from neuraminidase__InfluenzaA__AGQ81792
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauuaucgagcggaacacaguucaucucaauuccaccacaauugaacgcgagaucuguccuaaaguggcggaauacaagaacuggucuaaaccccagugccaaauuaccggguuugcuccuuucagcaaggacaauuccaucagacugucugccggaggcgauaucugggugacacgggagcccuaugucagcuguucccuuaacaaaugcuaccaguuugcccuggggcagggaaccacgcucgagaauaagcacagcaacggcaccacacaugaccgcaccccucacagaacacugcugaugaaugaacucggggugccguuccaucugggaaccaagcagguuuguauggcuuggucuuccagcucuugcuaugauggcaaagccuggcuucacauuugugugacgggcgacgauaagaacgcuacagccuccgucaucuacgacgggaugcugguggauagcauuggaucuuggucccaaaauauccuccggacccaggagagcgaaugcguuuguauuaacggcacaugcgcgguggucaugaccgacggguccgccucuggaaaagcugauacccgcgugcuguuuaucagagagggcaagaucauuaacaucagcccccuuuccgggagcgcccagcacguggaggaaugcucuuguuauccucgguaccccgagguccgcugcguuuguagagacaauuggaaaggauccaaccggccuauucuguauaucaauauggcugauuacagcauugaaucuagcuacgugugcuccggccucgugggcgacacaccccgcaacgaugacucuagcuccagcucuaauuguagagacccgaacaaugagcgcggggccccuggagucaagggcugggcguucgaugacgggaacgauguguggaugggacggacgaucaagaauggcuccagaagcggguaugaaaccuuucggguugugaacggauggacaauggccaauucuaaaucccagaucaacagacaagucauuguggacagcgaugacugguccggcuacucuggcaucuucagcguugaggggaagaaaugcauuaaucgcuguuuuuauguggagcugauccggggaagaccccaggaaccucgcgucugguggaccuccaacucuauuaucguguucugcggcacaagcgggaccuacggaacgggcuccuggcccgauggggcuaauauuaacuuuaugcccaucuga

SEQ ID NO: 206597 - RNA, 1401 nt, Artificial Sequence
  derived and/or modified sequence opt5 from neuraminidase__InfluenzaA__AGQ81793
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauuaucgagcggaacacaguucaucucaauuccaccacaauugaacgcgagaucuguccuaaaguggcggaauacaagaacuggucuaaaccccagugccaaauuaccggguuugcuccuuucagcaaggacaauuccaucagacugucugccggaggcgauaucugggugacacgggagcccuaugucagcuguucccuuaacaaaugcuaccaguuugcccuggggcagggaaccacgcucgagaauaagcacagcaacggcaccacacaugaccgcaccccucacagaacacugcugaugaaugaacucggggugccguuccaucugggaaccaagcagguuuguauggcuuggucuuccagcucuugcuaugauggcaaagccuggcuucacauuugugugacgggcgacgauaagaacgcuacagccuccgucaucuacgacgggaugcugguggauagcauuggaucuugguccaaaaauauccuccggacccaagagagcgaaugcguuuguauuaacggcacaugcgcgguggucaugaccgacggguccgccucuggaaaggcugauacccgcgugcuguuuaucagagagggcaaaaucauuaacaucagcccccuuuccgggagcgcccagcacguggaggaaugcucuuguuauccucgguaccccgagguccgcugcguuuguagagacaauuggaagggauccaaccggccuauucuguauaucaauauggcugauuacagcauugaaucuagcuacgugugcuccggccucgugggcgacacaccccgcaacgaugacucuagcuccagcucuaauuguagagacccgaacaaugagcgcggggccccuggagucaagggcugggcguucgaugacgggaacgauguguggaugggacggacgaucaaaaauggcuccagaagcggguaugaaaccuuucggguugugaacggauggacaauggccaauucuaagucccagaucaacagacaggucauuguggacagcgaugacugguccggcuacucuggcaucuucagcguugaggggaaaaagugcauuaaucgcuguuuuuauguggagcugauccggggaagaccccaagaaccucgcgucugguggaccuccaacucuauuaucguguucugcggcacaagcgggaccuacggaacgggcuccuggcccgauggggcuaauauuaacuuuaugcccaucuga

SEQ ID NO: 206598 - RNA, 1401 nt, Artificial Sequence; identical to SEQ ID NO: 206597
  derived and/or modified sequence opt5 from neuraminidase__InfluenzaA__AGQ81794

SEQ ID NO: 206599 - RNA, 1401 nt, Artificial Sequence
  derived and/or modified sequence opt5 from neuraminidase__InfluenzaA__AGQ81795
augaaccccaaucagaagaucauugccaucggcagcgugucccugauuaucgcuauuaucugccuccugaugcaaaucgccauucuuaccacaacgaugacccugcacuucagacagaacgaguguaauaacccuucuaauaaccaggucaugccgugcgaacccaucauuaucgagcggaauacaguucaucucaacagcaccacaauugaacgcgagaucuguccuaaaguggcggaauacaagaauugguccaaaccccagugccaaauuaccggguuugcuccuuucucuaaggacaacagcaucagacuguccgccggaggcgauaucugggugacacgggagcccuaugucucuuguagccuugacaaaugcuaccaguuugcccuggggcagggaaccacgcucaagaauaagcacuccaacggcaccacacaugaucgcaccccucacagaacacugcugaugaaugagcucggggugccguuccaucugggaaccaaacagguuuguauugcuuggucuagcuccagcugcuaugacggcaaggccuggcuucacaucugugugacgggcgaugacaaaaacgcuacagccucuauuaucuacgaugggaugcuggucgacuccauuggaagcuggucuaagaauauccuccggacccaagaauccgagugcguguguaucaacggcacaugcgcgguugugaugaccgaugggagcgccuccggaaaagcugacacccgcguccuguuuauuagagaaggcaagaucauuaacaucucuccccuuagcggguccgcccagcacguggaggagugcagcuguuauccucgguaccccgaagugcgcugcgucuguagagauaauuggaagggaucuaaccggccuauucuguauaucaauauggcugacuacuccaucgagagcucuuacguuugcagcggccucgugggcgauacaccccgcaacgacgacuccucuagcuccagcaauuguagagauccgaacaaugaacgcggggccccuggagugaaaggcugggcguucgacgaugggaacgacgucuggaugggacggacgauuaagaauggcucuagauccggguaugagaccuuucgggugguuaacggauggacaaucgccaauagcaaaucucagauuaacagacagaucauuguggauuccgacgauuggagcggcuacuccggcaucuucucugucgaagggaagaaaugcauuaaucgcuguuuuuauguggagcugauccggggaagaccccaagagccucgcguuugguggaccagcaacuccaucauuguguucugcggcacaucugggaccuacggaacgggcagcuggcccgacggggcuaauaucaacuuuaugcccauuuga

SEQ ID NO: 206600 - RNA, 1401 nt, Artificial Sequence
  derived and/or modified sequence opt5 from neuraminidase__InfluenzaA__AGQ81796
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauuaucgagcggaacacaguucaucucaauuccaccacaauugaacgcgagaucuguccuaaaguggcggaauacaagaacuggucuaaaccccagugccaaauuaccggguuugcuccuuucagcaaggacaauuccaucagacugucugccggaggcgauaucugggugacacgggagcccuaugucagcuguucccuugacaaaugcuaccaguuugcccuggggcagggaaccacgcucaagaacaagcacagcaauggcaccacacaugaucgcaccccucacagaacacugcugaugaacgagcucggggugccguuccaucugggaaccaaacagguuuguauugcuuggucuuccagcucuugcuaugacggcaaggccuggcuucacaucugugugacgggcgaugacaaaaaugcuacagccuccauuaucuacgaugggaugcuggucgacagcauuggaucuugguccaagaacauccuccggacccaagaaagcgagugcguguguaucaauggcacaugcgcgguugugaugaccgauggguccgccucuggaaaagcugacacccgcguccuguuuauuagagaaggcaagaucauuaacaucagcccccuuuccgggagcgcccagcacguggaggagugcucuuguuauccucgguaccccgaagugcgcugcgucuguagagauaacuggaagggauccaaucggccuauucuguauaucaacauggcugacuacagcaucgagucuagcuacguuugcuccggccucgugggcgauacaccccgcaaugacgacucuagcuccagcucuaacuguagagauccgaauaacgaacgcggggccccuggagugaaaggcugggcguucgacgaugggaaugacauuuggaugggacggacgaucaagaacggcuccagaagcggguaugagaccuuucgggucgugaauggauggacaauggccaacucuaaaucccagauuaauagacagguuaucguggauagcgacgauugguccggcuacucuggcauuuucagcgucgaagggaagaaaugcaucaaccgcuguuuuuauguggagcugauucggggaagaccccaagagccucgcguuugguggaccuccaauucuaucaucguguucugcggcacaagcgggaccuacggaacgggcuccuggcccgacggggcuaacauuaauuuuaugcccaucuga

SEQ ID NO: 206601 - RNA, 1401 nt, Artificial Sequence
  derived and/or modified sequence opt5 from neuraminidase__InfluenzaA__AGQ81798
augaaccccaaucagaagaucauuagcaucggcuccgugucucugauuaucgccauuaucugccuccugaugcaaaucgcuauucuuaccacaacgaugacccugcacuucagacagaacgaguguagcaauccuuccaacaaucaggucaugccgugcgaacccaucauuaucgagcggaacacaguucaucucaauucuaccacaauugaacgcgagaucuguccuaaaguggccgaauacaagaacuggagcaaaccccagugccaaauuaccggguuugcgccuuucuccaaggacaauucuaucagacugagcgcuggaggcgauaucugggugacacgggagcccuaugucuccuguagccuugacaaaugcuaccaguuugcccuggggcagggaaccacgcucaagaacaagcacucuaauggcaccacacaugaucgcaccccucacagaacacugcugaugaacgagcucggggugccguuccaucugggaaccaaacagguuuguauugccugguccuccucuuccugcuaugacggcaaggcuuggcuucacaucugugugacgggcgaugacaaaaaugccacagcuagcauuaucuacgaugggaugcuggucgacucuauuggauccuggagcaagaacauccuccggacccaagaauccgagugcguguguaucaauggcacaugcgccguugugaugaccgaugggucugcgagcggaaaagccgacacccgcguccuguuuauuagagaaggcaagaucauuaacaucagcccccuuagcgggucugcucagcacguggaggagugcuccuguuauccucgguaccccgaagugcgcugcgucuguagagauaacuggaagggaagcaaucggccuauucuguauaucaacauggccgacuacucuaucgagagcuccuacguuugcucuggccucgugggcgauacaccccgcaaugacgacagcuccucuagcuccaacuguagagauccgaauaacgaacgcggggcuccuggagugaaaggcugggccuucgacgaugggaaugacgucuggaugggacggacgauuaagaacggcagcagaucuggguaugagaccuuucgggugguuaauggauggacaauggcgaacuccaaaagccagaucaauagacaggugauugucgauuccgacgauuggucuggcuacagcggcaucuucuccguggaagggaagaaaugcauuaaccgcuguuuuuauguugagcugauccggggaagaccccaagagccucgcgugugguggaccucuaauagcauuaucgucuucugcggcacauccgggaccuacggaacgggcagcuggcccgacggggccaacaucaauuuuaugcccauuuga

SEQ ID NO: 206602 - RNA, 1401 nt, Artificial Sequence
  derived and/or modified sequence opt5 from neuraminidase__InfluenzaA__AGQ81799
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauuaucgagcggaacacaguucaucucaauuccaccacaauugaacgcgagaucuguccuaaaguggcggaauacaagaacuggucuaaaccccagugccaaauuaccggguuugcuccuuucagcaaggacaauuccaucagacugucugccggaggcgauaucugggugacacgggagcccuaugucagcuguucccuugacaaaugcuaccaguuugcccuggggcagggaaccacgcucaagaacaagcacagcaauggcaccacacaugaucgcaccccucacagaacacugcugaugaacgagcucggggugccguuccaucugggaaccaaacagguuuguauugcuuggucuuccagcucuugcuaugacggcaaggccuggcuucacaucugugugacgggcgaugacaaaaaugcuacagccuccauuaucuacgaugggaugcuggucgacagcauuggaucuugguccaagaacauccuccggacccaagaaagcgagugcguguguaucaauggcacaugcgcgguugugaugaccgauggguccgccucuggaaaagcugacacccgcguccuguuuauuagagaaggcaagaucauuaacaucagcccccuuuccgggagcgcccagcacguggaggagugcucuuguuauccucgguaccccgaagugcgcugcgucuguagagauaacuggaagggauccaaucggccuauucuguauaucaacauggcugacuacagcaucgagucuagcuacguuugcuccggccucgugggcgauacaccccgcaaugacgacucuagcuccagcucuaacuguagagauccgaauaacgaacgcggggccccuggagugaaaggcugggcguucgacgaugggaaugacgucuggaugggacggacgauuaagaacggcuccagaagcggguaugagaccuuucgggugguuaauggauggacaauggccaacucuaaaucccagaucaauagacaggugauugucgauagcgacgauugguccggcuacucuggcaucuucagcguggaagggaagaaaugcauuaaccgcuguuuuuauguugagcugauccggggaagaccccaagagccucgcgugugguggaccuccaauucuauuaucgucuucugcggcacaagcgggaccuacggaacgggcuccuggcccgacggggcuaacaucaauuuuaugcccauuuga

SEQ ID NO: 206603 - RNA, 1401 nt, Artificial Sequence; identical to SEQ ID NO: 206602
  derived and/or modified sequence opt5 from neuraminidase__InfluenzaA__AGQ81800

SEQ ID NO: 206604 - RNA, 1401 nt, Artificial Sequence
  derived and/or modified sequence opt5 from neuraminidase__InfluenzaA__AGQ81801
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauuaucgagcggaacacaguucaucucaauuccaccacaauugaacgcgagaucuguccuaaaguggcggaauacaagaacuggucuaaaccccagugccaaauuaccggguuugcuccuuucagcaaggacaauuccaucagacugucugccagcggagauaucugggugacacgggagcccuaugucuccuguagccuugacaaaugcuaccaguuugcccugggccaggggaccacgcucaagaacaagcacucuaauggaaccacacaugaucgcaccccucacagaacacugcugaugaacgagcucggcgugccguuccaucuggggaccaaacagguuuguauugcuugguccuccucuuccugcuaugacggaaaggccuggcuucacaucugugugacgggcgaugacaaaaaugcuacagccagcauuaucuacgauggcaugcuggucgacucuauuggguccuggagcaagaacauccuccggacccaagaauccgagugcguguguaucaauggaacaugcgcgguugugaugaccgauggcucugccagcgggaaagcugacacccgcguccuguuuauuagagaaggaaagaucauuaacaucagcccccuuagcggcucugcccagcacguggaggagugcuccuguuauccucgguaccccgaagugcgcugcgucuguagagauaacuggaaggggagcaaucggccuauucuguauaucaacauggcugacuacucuaucgagagcuccuacguuugcucuggacucgugggcgauacaccccgcaaugacgacagcuccucuagcuccaacuguagagauccgaauaacgaacggggcgccccuggggugaaaggaugggcguucgacgauggcaaugacgucuggauggggcgcacgauuaagaacggaagcagaucuggcuaugagaccuuucgggugguuaauggguggacaauggccaacuccaaaagccagaucaauagacaggugauugucgauuccgacgauuggucuggauacagcggcaucuucuccguggaaggcaagaaaugcauuaaccgcuguuuuuauguugagcugauccgggggagaccccaagagccucgcgugugguggaccucuaauagcauuaucgucuucugcggaacauccggcaccuacgggacgggaagcuggcccgacggcgcuaacaucaauuuuaugcccauuuga

SEQ ID NO: 206605 - RNA, 1401 nt, Artificial Sequence
  derived and/or modified sequence opt5 from neuraminidase__InfluenzaA__AGQ81802
augaaccccaaucagaagaucauugccaucggcagcgugucccugauuaucgcuauuaucugccuccugaugcaaaucgcccuucugaccacaacgaugacccuccacuucagacagaacgaguguucuaauccuagcaacaaucaggucaugccgugcgaacccauuaucauugagcggaacacaguucaucuuaauuccaccacaaucgaacgcgagauuuguccuaaaguggcggaauacaagaacuggucuaaaccccagugccaaaucaccggguuugcuccuuucagcaaggacaauuccauuagacugucugccggaggcgauaucugggugacacgggagcccuaugucagcuguucccuggacaaaugcuaccaguuugcccucgggcagggaaccacgcugaagaacaagcacagcaauggcaccacacaugaucgcaccccucacagaacacugcucaugaacgagcugggggugccguuccaucuuggaaccaaacagguuuguaucgcuuggucuuccagcucuugcuaugacggcaaggccuggcugcacauuugugugacgggcgaugacaaaaaugcuacagccuccaucauuuacaacgggaugcucgucgauagcaucggaucuugguccaagaauauucugcggacccaagaaagcgagugcguguguaucaacggcacaugcgcgguugugaugaccgacggguccgccucuggaaaagcugauacccgcguccuuuuuaucagagaaggcgagauuaucaacauuagcccccuguccgggagcgcccagcacguggaggaaugcucuuguuauccucgguaccccgaggugcgcugcgucuguagagacaauuggaagggauccaaccggccuauccucuauauuaauauggcugauuacagcaucgaaucuagcuacguuugcuccggccuggugggcgacacaccccgcaacgaugacucuagcuccagcucuaauuguagagacccgaacaaugagcgcggggccccuggagugaagggcugggcguucgaugacgggaacgaugucuggaugggacggacgaucaaaaauggcuccagaagcggguaugaaaccuuucgggugguuaacggauggacaauggccaauucuaagucccagauuaacagacaggugaucgucgacagcgaugacugguccggcuacucuggcauuuucagcguggaggggaaaaagugcaucaaucgcuguuuuuauguugagcugauucggggaagaccccaagaaccucgcgugugguggaccuccaacucuaucauugucuucugcggcacaagcgggaccuacggaacgggcuccuggcccgauggggcuaauaucaacuuuaugcccaucuga

SEQ ID NO: 206606 - RNA, 1401 nt, Artificial Sequence
  derived and/or modified sequence opt5 from neuraminidase__InfluenzaA__AGQ81803
augaaccccaaucagaagaucauugccaucggcagcgugucccugauuaucgcuauuaucugccuccugaugcaaaucgccauucuuaccacaacgaugacccugcacuucagacagaacgaguguucuaauccuagcaacaaucaggucaugccgugcgaacccaucauuaucgagcggaacacaguucaucucaauuccaccacaauugaacgcgagaucuguccuaaaguggcggaauacaagaacuggucuaaaccccagugccaaauuaccggguuugcuccuuucagcaaggacaauuccaucagacugucugccagcggagauaucugggugacacgggagcccuaugucuccuguagccuugacaaaugcuaccaguuugcccugggccaggggaccacgcucaagaacgagcacucuaauggaaccacacaugaucgcaccccucacagaacacugcugaugaacgaacucggcgugccguuccaucuggggaccaagcagguuuguauugcuugguccuccucuuccugcuaugacggaaaagccuggcuucacaucugugugacgggcgaugacaagaaugcuacagccagcauuaucuacgauggcaugcuggucgacucuauuggguccuggagcaaaaacauccuccggacccaagaguccgaaugcguguguaucaauggaacaugcgcgguugugaugaccgauggcucugccagcgggaaggcugacacccgcguccuguuuauuagagagggaaaaaucauuaacaucagcccccuuagcggcucugcccagcacguggaggaaugcuccuguuauccucgguaccccgaggugcgcugcgucuguagagauaacuggaaggggagcaaucggccuauucuguauaucaacauggcugacuacucuaucgaaagcuccuacguuugcucuggacucgugggcgauacaccccgcaaugacgacagcuccucuagcuccaacuguagagauccgaauaacgagcggggcgccccuggggugaagggaugggcguucgacgauggcaaugacgucuggauggggcgcacgauuaaaaacggaagcagaucuggcuaugaaaccuuucgggugguuaauggguggaucauggccaacuccaagagccagauuaauagacaggugaucgucgauuccgacgauuggucuggauacagcggcauuuucuccguggagggcaaaaagugcaucaaccgcuguuuuuauguugagcugauucgggggagaccccaagaaccucgcgugugguggacaucuaauagcaucaucgucuucugcggaaccuccggcacauacgggaccggaagcuggcccgacggcgcuaacauuaauuuuaugcccaucuga

SEQ ID NO: 206607 - RNA, 1410 nt, Artificial Sequence
  derived and/or modified sequence opt5 from neuraminidase__InfluenzaA__AGQ81804
augaaccccaaucagaagaugaucgccauuggcgcugugagccugaccaucgccauuaucugccuccugaugcaaacagcgauucuugucacgaccaugacacugcacuucaaacauaacgaguguaccaauuccucuaacaaucaggcugccccuugcgggccgaucaucauugaaagaaacguuacagagguggugcaccucaauagcaccacacuggaaaaggagaucugucccaaagccgcuggauaccggaacugguccaagccucagugccagauuaccggcuuugcccccuucucuaaagacaauagcauccgccuuuccgcugggggagauauuugggucacgagagaaccuuaugugucuuguggccuggggaagugcuaccaauuugcccucggacagggcaccacacuggacaacagccauuccaauggcaccagccacgaucggacaccccaucgcacccugcucaugaacgagcuggggguuccuuuccaccuuaugacgaaacagguguguaucgcguggucuuccagcucuugccacgacggaaaggccuggcugcaugucugugugacaggcgaugacagaaaugcuaccgccuccauuaucuaugggggaauccucguugauagcauuggcucuugguccaagaacauccugcggacacaggagagcgaaugcguguguauuaaugggaccugcgcugucgugaugaccgacggauccgccucuggcaaagcggauacacgcauccuuuuuauuagagagggcaagaucgugcacaucagcccgcuguccgggagcgcccaacaugucgaagagugcucuuguuacccccaguauccugagguucggugcgugugucgcgacaacuggagaggauccaaccggcccgugcucuacauuaauauggcugauuauagcaucgacucuggcuacgucugcagcgggcuggugggagauacgccucgcaacgacgacguuuccucuagcuccaauuguaaagaucccaacaaugaaagaggcgccccgggggugaagggaugggcuuucgacaacggcaaugauauuuggaugggccggaccaucgacaaggauagccgcucuggguacgagacauuuagagucauugacggauggaacaccgccaauuccaaaagccagacaucuagacaggugaucguuggcuccgauaacagcuccggguauucuggaaucuucagcguggaaggcaaguccugcauuaaucgguguuuuuacgucgagcugauccgcgggcggccuaaagaaaccagagugugguggacgucuaacagcauuaucgucuucugcggcacauccggaaccuauggcaccgggagcuggcccgacggagccaauauuaacuuuaugccuaucuga

SEQ ID NO: 206608 - RNA, 1401 nt, Artificial Sequence
  derived and/or modified sequence opt5 from neuraminidase__InfluenzaA__AGQ81805
augaaccccaaucagaagaucauugccaucggcagcgugucccugauuaucgcuauuaucugccuccugaugcaaaucgcccuucugaccacaacgaugacccuccacuucagacagaacgaguguucuaauccuagcaacaaucaggucaugccgugcgaacccauuaucauugagcggaacacaguucaucuuaauuccaccacaaucgaacgcgagauuuguccuaaaguggcggaauacaagaacuggucuaaaccccagugccaaaucaccggguuugcuccuuucagcaaggacaauuccauuagacugucugccggaggcgauaucugggugacacgggagcccuaugucagcuguucccuggacaaaugcuaccaguuugcccucgggcagggaaccacgaugaagaacaagcacagcaauggcaccacacaugaucgcaccccucacagaacacugcugaugaacgagcucggggugccguuccaucugggaaccaaacagguuuguaucgcuuggucuuccagcucuugcuaugacggcaaggccuggcuucacauuugugugacgggcgaugacaaaaaugcuacagccuccaucauuuacgaugggaugcuggucgacagcaucggaucuugguccaagaacauucuccggacccaagaaagcgagugcguguguaucaauggcacaugcgcgguugugaugaccgauggguccgccucuggaaaagcugacacccgcguccuguuuaucagagaaggcaagauuaucaacauuagcccccuuuccgggagcgcccagcacguggaggagugcucuuguuauccucgguaccccgaagugcgcugcgucuguagagauaacuggaagggauccaaucggccuauccuguauauuaacauggcugacuacagcaucgagucuagcuacguuugcuccggccucgugggcgauacaccccgcaaugacgacucuagcuccagcucuaacuguagagggccgaauaacgaacggggagccccuggcgugaaagggugggcguucgaugacggaaaugaugucuggaugggccgcacgaucaagaacggguccagaagcggauaugagaccuuucgggugguuaauggcuggacaauggccaacucuaaaucccagauuaauagacaggugaucgucgacagcgaugacugguccggcuacucugggauuuucagcguggaaggaaagaaaugcaucaaccgcuguuuuuauguugagcugauucggggcagaccccaagagccucgcgugugguggaccuccaauucuaucauugucuucugcgggacaagcggaaccuacggcacgggguccuggcccgauggcgcuaacaucaauuuuaugcccaucuga

SEQ ID NO: 206609 - RNA, 1401 nt, Artificial Sequence
  derived and/or modified sequence opt5 from neuraminidase__InfluenzaA__AGQ81807
augaaccccaaucagaagaucaccgccauuggcagcaucucccugauuaucgcuauuaucugccuccugaugcaaaucgccauucuuacaacgaccaugacacugcacuucagacagaacgagugucggaauccuucuaacaaucaggugaugccgugcgaacccgucaucauugagcgcaacaccguucaucucaauagcacaaccaucgaaagagagauuuguccuaaaguggcggaauacaagaacugguccaaaccccagugccaaaucacaggguuugcuccuuucucuaaggacaauagcauucggcuguccgccucuggagauaucugggugacccgcgagcccuaugucagcuguucccuuaacaaaugcuaccaguuugcccugggccaggggacgacccucaagaauaagcacagcaacggaacaacccaugacagaacaccucaccggacccugcugaugaaugagcucggcgugccguuccaucuggggacgaaacagguuuguaucgcuuggucuuccagcucuugcuaugauggaaaggccuggcuucacauuugugugacaggcgacgauaaaaacgcuaccgccuccaucauuuacgacggcaugcuggucgauagcaucgggucuugguccaagaauauucuccgcacacaagaaagcgagugcguguguaucaacggaaccugcgcgguugugaugaccgacggcuccgccucugggaaagcugauacaagaguccuguuuaucaaggaaggaaagauuaucaacauuagcccccuuuccggcagcgcccagcacguggaggagugcucuuguuauccucgguaccccgaagugcgcugcgucuguagagacaauuggaaaggguccaaccggccuauccuguauauuaauauggcugauuacagcaucgagucuagcuacguuugcuccggacucgugggcgacacgccccgcaacgaugacucuagcuccagcucuaauuguagagacccgaacaaugaacggggcgccccuggggugaagggaugggcguucgaugacggcaacgaugucuggauggggcgcaccaucaaaaauggauccagaagcggcuaugagacauuucgggugguuaacggguggauuauggccaauucuaagucccagaucaacagacaggugauugucgacagcgaugacugguccggauacucuggcaucuucagcguggaaggcaaaaagugcauuaaucgcuguuuuuauguugagcugauccgggggagaccccaagagccucgcgugugguggaccuccaacucuauuaucgucuucugcggaacaagcggcaccuacgggacgggauccuggcccgauggcgcuaauaucaacuuuaugcccauuuga

SEQ ID NO: 206610 - RNA, 1401 nt, Artificial Sequence
  derived and/or modified sequence opt5 from neuraminidase__InfluenzaA__AGQ81808
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauucugaucgagagaaacaccgugcaucucaauuccacaaccauugaaaaggagguguguccuaaagucgcggaauacaagaacuggucuaaaccccagugccaaaucacaggguucgcuccuuuuagcaaggacaauuccauucggcugucugccggaggcgauaucugggugacccgcgagcccuauguuagcuguucccuugggaagugcuaccaguucgcccugggacagggcacgacccucaaaaacaaucacagcaacgggacaacccaugacagaacaccucaccggacccugcugaugaaugagcucggagugccguuucaucugggcacgaagcaggucuguauugcuuggucuuccagcucuugcuaugauggcaaagccuggcuucacaucugugugacaggggacgauaagaacgcuaccgccuccaucauuuacgacggaaugcugguugauagcaucggcucuugguccaaaaauauucuccgcacacaagaaagcgagugcguguguaucaacgggaccugcgcggucgugaugaccgacggauccgccucuggcaaggcugauacacggauucuguucaucagagaagggaagaucauuaacaucagcccccuuuccggaagcgcccagcacguggaggagugcucuuguuauccucgcuaccccgaagucagaugcguuugucgggacaauuggaaaggcuccaaccgcccugugcuguauauuaauauggcugauuacagcguggagucuagcuacgucugcuccggccucgugggggacacgcccagaaacgaugacucuagcuccagcucuaauugucgggacccgaacaaugaacgcggagccccuggcguuaaggggugggcguuugaugacggaaacgauguguggaugggcagaaccauccggaauaacucccgcagcggguaugagacauucagagucgugaauggauggaccacagccaacucuaaaucccagauuaaucggcagaucaucguugacagcgaaaacugguccggcuacucuggcauuuuuagcguggaggggaagaauugcaucaacagauguuucuaugucgagcugauucgcggacggccccaagaaccuagagugugguggaccuccaacucuaucauugucuuuugcggcacgagcgggacauacggaaccggcuccuggcccgauggggcuaauaucaacuucaugcccauuuga

SEQ ID NO: 206611 - RNA, 1401 nt, Artificial Sequence
  derived and/or modified sequence opt5 from neuraminidase__InfluenzaA__AGQ81809
augaaccccaaucagaagaucaccgccauuggcagcgugucccugaucauugcuaucauuugccuccugaugcaaaucgccauccuuacaacgaccaugacacugcacuucagacagaacgaguguucuaauccuagcaacaaucaggucaugccgugcgaacccauuaucauugagcggaacaccguucaucucaauuccacaaccaucgaacgcgagauuuguccuaaaguggcggaauacaagaacuggucuaaaccccagugccaaaucacaggguuugcuccuuucagcaaggacaauuccauuagacugucugccggaggcgauaucugggugacccgggagcccuaugucagcuguuccccugacaaaugcuaccaguuugcccuugggcagggaacgacccugaagaacaagcacagcaauggcacaacccaugaucgcacaccgcacagaacccuccugaugaacgagcugggggugcccuuccaucucggaacgaaacagguuuguaucgcuuggucuuccagcucuugcuaugacggcaaggccuggcugcacauuugugugacaggcgaugacaaaaaugcuaccgccuccaucauuuacgaugggaugcuugucgacagcaucggaucuugguccaagaacauucugcggacacaagaaagcgagugcguguguaucaauggaaccugcgcgguugugaugaccgauggguccgccucuggagaagcugacacacgcauccucuuuauuagagagggcaaaaucauuaacaucagcccucuguccgggagcgcccagcacgucgaggaaugcucuuguuauccccgguacccugaggugcgcugcguguguagagauaacuggaagggauccaaucggcccauuaucuauaucaacauggucgacuacagcauuggcucucgcuacguuugcagcggccuugugggggauacgccgagaaaugacgacuccaccucuagcuccaacugucgggauccuaauaacgaacgcggagcucccggcgugaaggggugggccuucgacgauggaaaugacgucuggaugggcagaacaaucaaaaacgggagccggucuggauaugagaccuuuagagugauuaauggcuggacaauggcgaacuccaagagccagaucaaucgccagguuauuguggauucugacaacugguccggcuacagcgggaucuucuccgucgaaggcaaaaagugcauuaaucgguguuuuuauguggagcugaucagaggccgcccucaagagccccggguuugguggaccucuaacagcaucauuguguucugcgggacguccggaacauacggcaccgggucuuggcccgauggcgccgacaucaauuuuaugccuauuuga

SEQ ID NO: 206612 - RNA, 1401 nt, Artificial Sequence
  derived and/or modified sequence opt5 from neuraminidase__InfluenzaA__AGQ81810
augaaccccaaucagaagauccuggccauuggcagcgugucccucaccaucgcuauuaucugcuuccugaugcaaauugccauccuuacaacgaccaugacacugcacuuuaaacagaacgaguguucuaauccuagcaacaaucaggucguuccgugcgaacccauccucauugagagaaacaccgugcaucuuaauuccacaaccaucgaaaaggagguguguccuaaagucgcggaauacaagaacuggucuaaaccccagugccaaauuacaggguucgcuccuuuuagcaaggacaauuccauccggcugucugccggaggcgauauuugggugacccgcgagcccuauguuagcuguucccuggggaagugcuaccaguucgcccucggacagggcacgacccugaaaaacaaucacagcaacgggacaacccaugacagaacaccucaccggacccugcucaugaaugagcugggagugccguuucaucuuggcacgaagcaggucuguaucgcuuggucuuccagcucuugcuaugauggcaaagccuggcugcacauuugugugacaggggacgauaagaacgcuaccgccuccaucaucuacgacggaaugcucguugauagcauuggcucuugguccaaaaauauccugcgcacacaagaaagcgagugcguguguauuaacgggaccugcgcggucgugaugaccgacggauccgccucuggcaaggcugauacaagaauccuuuucauucgggaagggaagaucaucaacauuagcccccuguccggaagcgcccagcacguggaggagugcucuuguuauccucgcuaccccgaagucagaugcguuugucgggacaauuggaaaggcuccaaccgcccugugcucuauaucaauauggcugauuacagcauugagucuagcuacgugugcuccggccuggucggggacacgcccagaaacgaugacucuagcuccagcucuaauugucgggacccgaacaaugaacgcggagccccuggcgugaaggggugggcguuugaugacggaaacgauguuuggaugggcagaaccauccggaauaacucccgcagcggguaugagacauucagaguggucaauggauggaccacagccaacucuaaaucccagauuaauagacaggugaucguugacagcgaaaacugguccggcuacucuggcaucuuuagcguggaggggaagaauugcauuaaccgguguuucuaugucgagcugauccgcggacggccccaagaaccuagagugugguggaccuccaacucuauuaucgucuuuugcggcacgagcgggacauacggaaccggcuccuggcccgauggggcuaauauuaacuucaugcccaucuga

SEQ ID NO: 206613 - RNA, 1401 nt, Artificial Sequence
  derived and/or modified sequence opt5 from neuraminidase__InfluenzaA__AGQ81811
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauucugaucgagagaaacaccgugcaucucaauuccacaaccauugaaaaggagguguguccuaaagucgcggaauacaagaacuggucuaaaccccagugccaaaucacaggguucgcuccuuuuagcaaggacaauuccauucggcugucugccggaggcgauaucugggugacccgcgagcccuauguuagcuguucccuugggaagugcuaccaguucgcccugggacagggcacgacccucaaaaacaagcacagcaaugggacaacccaugacagaacaccucaccggacccugcugaugaacgagcucggagugccguuucaucugggcacgaaacaggucuguauugcuuggucuuccagcucuugcuaugauggcaaggccuggcuucacaucugugugacaggggacgauaaaaaugcuaccgccuccaucauuuacgacggaaugcugguugauagcaucggcucuugguccaagaacauucuccgcacacaagaaagcgagugcguguguaucaaugggaccugcgcggucgugaugaccgacggauccgccucuggcaaggcugauacacggauucuguucauccgggaagggaaaaucgugaacauuagcccccuuuccggaagcgcccagcacgucgaggagugcucuuguuauccucgcuaccccgaaguuagaugcgugugucgggacaacuggaagggcuccaaucgcccugugcuguauaucaacauggcugauuacagcgucgagucuagcuacgugugcuccggccucguuggggacacgcccagaaaugaugacucuuuuagcuccagcaacugucgggacccgaauaacgaacgcggagccccuggcgugaaagggugggcguucgaugacggaaaugaugucuggaugggcagaaccauucggaacgacucucgcuccggguaugagacauuuagagugguuaauggauggaccacagccaacagcaagucucagaucaauagacaggugauugucgauuccgaaagcugguccggcuacucuggcaucuucagcguggaggggaaaaacugcaucaauagauguuuuuaugucgagcugauucgcggacggccccaagaaccuagagugugguggaccuccaacucuaucauuguuuucugcggcacgagcgggacauacggaaccggcuccuggcccgacggggcuaauaucaacuuuaugcccauuuga

SEQ ID NO: 206614 - RNA, 1410 nt, Artificial Sequence
  derived and/or modified sequence opt5 from neuraminidase__InfluenzaA__AGQ81812
augaaccccaaucagaagaucauuaccaucggcagcgugucccugacaauugccacgaucugcuuccucaugcaaauugcuauccuggucaccacaaucacccuucacuuuaaacagaacgaguguucuauuccuagcaauaaccagguugugccgugcgaacccaucauuguggagagaaauaucacagaaauugucuaccugaacaauaccacaaucgagaaggaacucuguccuaaacugaccgaguaucgggacugguccaagccccagugccaaauuacgggguucgccccuuuuucuaaagauaacagcauccgccuuuccgcgggaggcgacaucugggugaccagagagcccuacguuucuuguagcccuaauaagugcuaucaguucgcucuggggcagggaacaacccucgauaacaagcauuccaauggcacaauucacgaccggaucccgcaucgcacccugcugaugaacgaacucggggugcccuuucaccugggaacgaaacaggucuguauugccuggucuagcuccagcugccaugauggcaaggccuggcuucacguguguguuacaggcgacgauagaaaugcuaccgccucuuucaucuacgacgggaugcugguggauuccauuggaagcuggucucaaaacauccuccggacacaggaguccgaaugcgucuguaucaaugggaccugcaccguggugaugacagacggcagcgcuuccggacgcgccgauacgcggauucuguuuaucaaagagggcaagauuguccacguuucuccucuuagcggguccgcgcagcauaucgaggaaugcagcuguuaucccagauacccugacgugcgcugcguguguagagauaacuggaaaggaucuaaccggcccauuaucgacaucaaugucgccgacuauuccauugauagcucuuacgugugcagcggccugguuggcgacaccccgcgcaacgaugacuccucuagcaauuccaacuguaaggauccuaauaacgagagagggaaucccggagugaagggcugggcuuucgacuacgggaacgaugucuggaugggacggacaaucagcaaagacucucgcuccggcuaugaaaccuuuagagugauugggggauggacaaccgccaauagcaagucucagguuaaccggcaagugaucgucgauaauaacaauugguccggcuacagcggcauuuucuccguggaggggaaaucuugcaucaacagauguuuuuaugucgaacucauucgcggacggccucaggagacgagagugugguggacaagcaauuccaucguuguguucugcggcaccucugggaccuacggaacaggcagcuggcccgacggggcuaacaucaacuuuaugcccauuuga

SEQ ID NO: 206615 - RNA, 1401 nt, Artificial Sequence
  derived and/or modified sequence opt5 from neuraminidase__InfluenzaA__AGQ81814
augaaccccaaucagaagaucauugccaucggcagcgugucccugaccauugcuaucaugugcuuccucaugcaaauugccauccugacaacgaccaugacacuucacuuuaaacagaacgaguguucuaauccuagcaacaaucaggucguuccgugcgaacccauccugauugagagaaacaccgugcaucucaauuccacaaccaucgaaaaggagguguguccuaaagucgcggaauacaagaacuggucuaaaccccagugccaaauuacaggguucgcuccuuuuagcaaggacaauuccauccggcugucugccggaggcgauauuugggugacccgcgagcccuauguuagcuguucccuugggaagugcuaccaguucgcccugggacagggcacgacccucaaaaacaaucacagcaacgggacaacccaugacagaacaccucaccggacccugcugaugaaugagcucggagugccguuucaucugggcacgaagcaggucuguaucgcuuggucuuccagcucuugcuaugauggcaaagccuggcuucacauuugugugacaggggacgauaagaacgcuaccgccuccaucaucuacgacggaaugcugguugauagcauuggcucuugguccaaaaauauccuccgcacacaagaaagcgagugcguguguauuaacgggaccugcgcggucgugaugaccgacggauccgccucuggcaaggcugauacaagaauccuguucauucgggaagggaagaucaucaacauuagcccccuuuccggaagcgcccagcacguggaggagugcucuuguuauccucgcuaccccgaagucagaugcguuugucgggacaauuggaaaggcuccaaccgcccugugcuguauaucaauauggcugauuacagcguggagucuagcuacgucugcuccggccucgugggggacacgcccagaaacgaugacucuagcuccagcucuaauugucgggacccgaacaaugaacgcggagccccuggcguuaaggggugggcguuugaugacggaaacgauguguggaugggcagaaccauucggaauaacucccgcagcggguaugagacauucagagucgugaauggauggaccacagccaacucuaaaucccagaucaaucggcagguuauuguggacagcgaaaacugguccggcuacucuggcaucuuuagcgucgaggggaagaauugcaucaacagauguuucuauguggagcugauucgcggacggccccaagaaccuagagucugguggaccuccaacucuaucauuguguuuugcggcacgagcgggacauacggaaccggcuccuggcccgauggggcuaauaucaacuucaugcccauuuga

SEQ ID NO: 206616 - RNA, 1401 nt, Artificial Sequence
  derived and/or modified sequence opt5 from neuraminidase__InfluenzaA__AGQ81815
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauucugaucgagagaaacaccgugcaucucaauuccacaaccauugaaaaggagguguguccuaaagucgcggaauacaagaacuggucuaaaccccagugccaaaucacaggguucgcuccuuuuagcaaggacaauuccauucggcugucugccggaggcgauaucugggugacccgcgagcccuauguuagcuguucccuugggaagugcuaccaguucgcccugggacagggcacgacccucaaaaacaagcacagcaaugggacaacccaugacagaacaccucaccggacccugcugaugaacgagcucggagugccguuucaucugggcacgaaacaggucuguauugcuuggucuuccagcucuugcuaugauggcaaggccuggcuucacaucugugugacaggggacgauaaaaaugcuaccgccuccaucauuuacgacggaaugcugguugauagcaucggcucuugguccaagaacauucuccgcacacaagaaagcgagugcguguguaucaaugggaccugcgcggucgugaugaccgacggauccgccucuggcaaggcugauacacggauucuguucauccgggaagggaaaaucauuaacaucagcccccuuuccggaagcgcccagcacguggaggagugcucuuguuauccucgcuaccccgaagucagaugcguuugucgggacaacuggaagggcuccaaucgcccugugcuguauauuaacauggcugauuacagcguggagucuagcuacgucugcuccggccucgugggggacacgcccagaaaugaugacucuagcuccagcucuaacugucgggacccgaauaacgaacgcggaaccccuggcguuaaagggugggccuuugaugacggaaaugauguguggaugggcagaacaauccggaacgacucccgcagcggguaugagaccuucagagucauuaauggauggacaaccgcgaacucuaagucccagaucaauagacaggugaucguugauagcgaaaacugguccggcuacucuggcauuuuuagcguggaggggaaaaauugcaucaacagauguuucuaugucgagcugauucgcggacggccccaagaaccuagagugugguggacguccaauucuaucauugucuuuugcggcacaagcgggaccuacggaaccggcuccuggcccgacggggccaacaucaacuauaugcccauuuga

SEQ ID NO: 206617 - RNA, 1401 nt, Artificial Sequence
  derived and/or modified sequence opt5 from neuraminidase__InfluenzaA__AGQ81816
augaaccccaaucagaagaucauugccaucggcagcgugucccugaccauugcuaucauuugcuuccucaugcaaaucgccauccugacaacgaccaugacacuucacuuuaaacagaacggguguucuaauccuagcaacaaucaggucguuccgugcgagcccauucugaucgaaagaaacaccgugcaucucaauuccacaaccauugagaaggaaguguguccuaaagucgcggaguacaagaacuggucuaaaccccagugccaaaucacaggauucgcuccuuuuagcaaggacaauuccauucggcugucugccggcggggauaucugggugacccgcgaacccuauguuagcuguucccuuggaaagugcuaccaguucgcccugggccaggggacgacccucaaaaacaagcacagcaauggaacaacccaugacagaacaccucaccggacccugcugaugaacgagcucggcgugccguuucaucugggcacgaaacaggucuguauugcuuggucuuccagcucuugcuaugaugggaaggccuggcuucacaucugugugacaggagacgauaaaaaugcuaccgccuccaucauuuacgacggcaugcugguugauagcaucgggucuugguccaagaacauucuccgcacacaagagagcgaaugcguguguaucaauggaaccugcgcggucgugaugaccgacggcuccgccucugggaaggcugauacacggauucuguucauccgggagggaaaaaucauuaacaucagcccccuuuccggcagcgcccagcacguggaagagugcucuuguuauccucgcuaccccgaggucagaugcguuugucgggacaacuggaagggcuccaaucgcccugugcuguauauuaacauggcugauuacagcguggaaucuagcuacgucugcuccgggcucgugggagacacgcccagaaaugaugacucuagcuccagcucuaacugucgggacccgaauaacgagcgcggcaccccugggguuaaaggaugggccuuugaugacggcaaugauguguggauggggagaacaauccggaacgacucccgcagcggauaugaaaccuucagagucauuaauggcuggacaaccgcgaacucuaagucccagaucaauagacaggugaucguugauagcgagaacugguccggcuacucugggauuuuuagcguggaaggcaaaaauugcaucaacagauguuucuaugucgagcugauucgcggacggccccaagagccuagagugugguggacguccaauucuaucauugucuuuugcgggacaagcggaaccuacggcaccggguccuggcccgacggcgccaacaucaacuauaugcccauuuga

SEQ ID NO: 206618 - RNA, 1401 nt, Artificial Sequence; identical to SEQ ID NO: 206616
  derived and/or modified sequence opt5 from neuraminidase__InfluenzaA__AGQ81817

SEQ ID NO: 206619 - RNA, 1401 nt, Artificial Sequence; identical to SEQ ID NO: 206616
  derived and/or modified sequence opt5 from neuraminidase__InfluenzaA__AGQ81818

SEQ ID NO: 206620 - RNA, 1401 nt, Artificial Sequence; identical to SEQ ID NO: 206616
  derived and/or modified sequence opt5 from neuraminidase__InfluenzaA__AGQ81819

SEQ ID NO: 206621 - RNA, 1401 nt, Artificial Sequence
  derived and/or modified sequence opt5 from neuraminidase__InfluenzaA__AGQ81820
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauucugaucgagagaaacaccgugcaucucaauuccacaaccauugaaaaggagguguguccuaaagucgcggaauacaagaacuggucuaaaccccagugccaaaucacaggguucgcuccuuuuagcaaggacaauuccauucggcugucugccggaggcgauaucugggugacccgcgagcccuauguuagcuguucccuugggaagugcuaccaguucgcccugggacagggcacgacccucaaaaacaagcacagcaaugggacaacccaugacagaacaccucaccggacccugcugaugaacgagcucggagugccguuucaucugggcacgaaacaggucuguauugcuuggucuuccagcucuugcuaugauggcaaggccuggcuucacaucugugugacaggggacgauaaaaaugcuaccgccuccaucauuuacgacggaaugcugguugauagcaucggcucuugguccaagaacauucuccgcacacaagaaagcgagugcguguguaucaaugggaccugcgcggucgugaugaccgacggauccgccucuggcaaggcugauacacggauucuguucaucagagaagggaaaaucauuaacaucagcccccuuuccggaagcgcccagcacguggaggagugcucuuguuauccucgcuaccccgaagucagaugcguuugucgggacaacuggaagggcuccaaucgcccugugcuguauauuaacauggcugauuacagcaucgagucuagcuacgugugcuccggccucgucggggacacgcccagaaaugaugacucuagcuccagcucuaacugucgggacccgaauaacgaacgcggaaccccuggcgugaaagggugggccuuugaugacggaaaugauguuuggaugggcagaacaauucggaacgacucccgcagcggguaugagaccuucagagugaucaauggauggacaaccgcgaacucuaagucccagaucaaucggcaggucauuguggauagcgaaaacugguccggcuacucuggcaucuuuagcguugaggggaaaaauugcauuaacagauguuucuauguggagcugauccgcggacggccccaagaaccuaaggucugguggacguccaauucuauuaucguguuuugcggcacaagcgggaccuacggaaccggcuccuggcccgacggggccaacauuaacuucaugcccaucuga

SEQ ID NO: 206622 - RNA, 1401 nt, Artificial Sequence
  derived and/or modified sequence opt5 from neuraminidase__InfluenzaA__AGQ81822
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauucugaucgagagaaacaccgugcaucucaauuccacaaccauugaaaagaaaguguguccuaaggucgcggaguacaaaaacuggucuaagccccagugccaaaucacaggguucgcuccuuuuagcaaggacaauuccauucggcugucugccggaggcgauaucugggugacccgcgaacccuauguuagcuguucccuugggaaaugcuaccaguucgcccugggacagggcacgacccucaagaacaaacacagcaaugggacaacccaugacagaacaccucaccggacccugcugaugaacgagcucggagugccguuucaucugggcacgaagcaggucuguauugcuuggucuuccagcucuugcuaugauggcaaagccuggcuucacaucugugugacaggggacgauaagaaugcuaccgccuccaucauuuacgacggaaugcugguugauagcaucggcucuugguccaagaacauucuccgcacacaagagagcgaaugcguguguaucaaugggaccugcgcggucgugaugaccgacggauccgccucuggcaaagcugauacacggauucuguucauccgggaggggaagaucauuaacaucagcccccuuuccggaagcgcccagcacguggaagagugcucuuguuauccucgcuaccccgaggucagaugcguuugucgggacaacuggaaaggcuccaaucgcccugugcuguauauuaacauggcugauuacagcguggaaucuagcuacgucugcuccggccucgugggggacacgcccagaaaugaugacucuagcuccagcucuaacugucgggacccgaauaacgagcgcggaaccccuggcguuaaggggugggccuuugaugacggaaaugauguguggaugggcagaacaauccggaacgacucccgcagcggguaugaaaccuucagagucauuaauggauggacaaccgcgaacucuaaaucccagaucaauagacaggugaucguugauagcgagaacugguccggcuacucuggcauuuuuagcguggaagggaagaauugcaucaacagauguuucuaugucgagcugauucgcggacggccccaagagccuagagugugguggacguccaauucuaucauugucuuuugcggcacaagcgggaccuacggaaccggcuccuggcccgacggggccaacaucaacuauaugcccauuuga

SEQ ID NO: 206623 - RNA, 1401 nt, Artificial Sequence
  derived and/or modified sequence opt5 from neuraminidase__InfluenzaA__AGQ81823
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauucugaucgagagaaacaccgugcaucucaauuccacaaccauugaaaaggagguguguccuaaagucgcggaauacaagaacuggucuaaaccccagugccaaaucacaggguucgcuccuuuuagcaaggacaauuccauucggcugucugccggaggcgauaucugggugacccgcgagcccuauguuagcuguucccuugggaagugcuaccaguucgcccugggacagggcacgacccucaaaaacaagcacagcaaugggacaacccaugacagaacaccucaccggacccugcugaugaacgagcucggagugccguuucaucugggcacgaaacaggucuguauugcuuggucuuccagcucuugcuaugauggcaaggccuggcuucacaucugugugacaggggacgauaaaaaugcuaccgccuccaucauuuacgacggaaugcugguugauagcaucggcucuugguccaagaacauucuccgcacacaagaaagcgagugcguguguaucaaugggaccugcgcggucgugaugaccgacggauccgccucuggcaaggcugauacacggauucuguucaucagagaagggaaaaucauuaacaucagcccccuuuccggaagcgcccagcacguggaggagugcucuuguuauccucgcuaccccgaagucagaugcguuugucgggacaacuggaagggcuccaaucgcccugugcuguauauuaacauggcugauuacagcguggagucuagcuacgucugcuccggccucgugggggacacgcccagaaaugaugacucuagcuccagcucuaacugucgggacccgaauaacgaacgcggagccccuggcguuaaagggugggcguuugaugacggaaaugauguguggaugggcagaaccauccggaacgacucccgcagcggguaugagacauucagagucgugaauggauggaccacagccaacucuaagucccagauuaaucggcagguuaucguggauagcgaaaacugguccggcuacucuggcaucuuuagcgucgaggggaaaaauugcauuaacagauguuucuauguggagcugauccgcggacggccccaagaaccuagagucugguggaccuccaauucuauuaucguguuuugcggcacgagcgggacauacggaaccggcuccuggcccgacggggcuaacauuaacuucaugcccaucuga

SEQ ID NO: 206624 - RNA, 1401 nt, Artificial Sequence; identical to SEQ ID NO: 206623
  derived and/or modified sequence opt5 from neuraminidase__InfluenzaA__AGQ81824

SEQ ID NO: 206625 - RNA, 1401 nt, Artificial Sequence; identical to SEQ ID NO: 206623
  derived and/or modified sequence opt5 from neuraminidase__InfluenzaA__AGQ81825

SEQ ID NO: 206626 - RNA, 1401 nt, Artificial Sequence
  derived and/or modified sequence opt5 from neuraminidase__InfluenzaA__AGQ81831
augaaccccaaucagaagauccuggccauuggcagcgugucccucaccaucgcuauuaucugcuuccugaugcaaauugccauccuuacaacgaccaugacacugcacuuuaaacagaacgaguguucuaauccuagcaacaaucaggucguuccgugcgaacccauccucauugagagaaacaccgugcaucuuaauuccacaaccaucgaaaaggagguguguccuaaagucgcggaauacaagaacuggucuaaaccccagugccaaauuacaggguucgcuccuuuuagcaaggacaauuccauccggcugucugccggaggcgauauuugggugacccgcgagcccuauguuagcuguucccuggggaagugcuaccaguucgcccucggacagggcacgacccugaaaaacaagcacagcaaugggacaacccaugacagaacaccucaccggacccugcucaugaacgagcugggagugccguuucaucuuggcacgaaacaggucuguaucgcuuggucuuccagcucuugcuaugauggcaaggccuggcugcacauuugugugacaggggacgauaaaaaugcuaccgccuccaucaucuacgacggaaugcucguugauagcauuggcucuugguccaagaacauccugcgcacacaagaaagcgagugcguguguauuaaugggaccugcgcggucgugaugaccgacggauccgccucuggcaaggcugauacaagaauccuuuucauucgggaagggaaaaucgugaacaucagcccccuguccggaagcgcccagcacgucgaggagugcucuuguuauccucgcuaccccgaaguuagaugcgugugucgggacaacuggaagggcuccaaucgcccugugcucuauauuaacauggcugauuacagcgucgagucuagcuacgugugcuccggccugguuggggacacgcccagaaaugaugacucuuuuagcuccagcaacugucgggacccgaauaacgaacgcggagccccuggcgugaaagggugggcguucgaugacggaaaugaugucuggaugggcagaaccauccggaacgacucucgcuccggguaugagacauuuagagugguuaauggauggaccacagccaacagcaagucucagauuaauagacaggugaucgucgauuccgaaagcugguccggcuacucuggcauuuucagcguggaggggaaaaacugcaucaaucgguguuuuuaugucgagcugauccgcggacggccccaagaaccuagagugugguggaccuccaacucuauuaucguuuucugcggcacgagcgggacauacggaaccggcuccuggcccgacggggcuaauauuaacuuuaugcccaucuga

SEQ ID NO: 206627 - RNA, 1401 nt, Artificial Sequence; identical to SEQ ID NO: 206616
  derived and/or modified sequence opt5 from neuraminidase__InfluenzaA__AGQ81837

SEQ ID NO: 206628 - RNA, 1401 nt, Artificial Sequence; identical to SEQ ID NO: 206616
  derived and/or modified sequence opt5 from neuraminidase__InfluenzaA__AGQ81838

SEQ ID NO: 206629 - RNA, 1401 nt, Artificial Sequence; identical to SEQ ID NO: 206623
  derived and/or modified sequence opt5 from neuraminidase__InfluenzaA__AGQ81839

SEQ ID NO: 206630 - RNA, 1401 nt, Artificial Sequence; identical to SEQ ID NO: 206623
  derived and/or modified sequence opt5 from neuraminidase__InfluenzaA__AGQ81840

SEQ ID NO: 206631 - RNA, 1401 nt, Artificial Sequence; identical to SEQ ID NO: 206616
  derived and/or modified sequence opt5 from neuraminidase__InfluenzaA__AGQ81841

SEQ ID NO: 206632 - RNA, 1410 nt, Artificial Sequence
  derived and/or modified sequence opt5 from neuraminidase__InfluenzaA__AGQ81843
augaaccccaaucagaagaucauuaccaucggcguggucaacacaacgcugagcaccauugcccuccugaucgggauuggaaaucuuaucuucaacacaguuauccacgagaaaauuggcgugcaucaaaccguggucuacccuacaaucaccccgcccgugauuccuaauugcuccgacacaaccaucacguauaacaauaccguugugaacaauauuacaaccacaaucauuaacaaggcugaaaaacaguuuaagcccucucugccucucugucccuucagaggguuuuucccuuuucacaaagauaaugccauccggcugggagagaacaaggacgucaucgugacccgcgaaccguacguuagcugcgauaaugacgauuguugguccuucgcgcuugcucagggcgcccugcucgggacgaagcauucuaacggaacaauuaaagacagaacccccuaucggagccugauccgcuuuccuauuggcacagcccccgugcugggcaauuacaaggagaucugcgucgcuugguccucuagcuccuguuucgaugggaaagaauggaugcacgugugcaugaccggaaacgacaacgaugccagcggccagauuaucuaugcugggaagaugaccgacucuaucaaauccuggagacgggauauucuccgcacacaagagagcgagugucagugcaucgacggaacguguauuguggccgucaccgauggcccugcggccucuuccgcugaccauagaaucuacuggauucgggaagggaagaucaucaaguaugaggacauucccaaaacaaagauccagcaccuggaagagugcagcuguuacguugauaccgacguguacugcauuugccgcgauaauuggaaaggaucuaacagaccguggaugcggaucaauaacgagacaauucuugaaaccggcuauguguguuccaaguuucacagcgacacgccucgccccgccgauccuuccacagucucuugcgacagccccuccaauaucaacggcgggcccggagugaaaggcuucggguuuagagcuggaaaugauguuuggcugggccggaccgugagcaccacagggcgcucuggauucgaggucauuaaggugaccgaaggcuggaucaacucccucaaucaugccaaaagcguuacacagacgcuggugucuaacaaugacuggagcggcuacuccgggucuuuuaucgucgagaacaauggauguuuccaaccuugcuucuauauugaacuuaucagaggccggccgaacagaaaugaugacgugagcuggaccuccaacagcauugucacauuuugugggcuggauaacgagcccggaucuggcaauuggccugacggguccaacaucggcuucaugcccaaguga

SEQ ID NO: 206633 - RNA, 1410 nt, Artificial Sequence
  derived and/or modified sequence opt5 from neuraminidase__InfluenzaA__AGQ81845
augaaccccaaucagaagaucauuaccaucggcguggucaacacaacgcugagcaccauugcccuccugaucgggauuggaaaucuuaucuucaacacaguuauccacgagaaaauuggcgugcaucaaaccgugaucuacccuacaauuaccuccccggucgugcccaauugcucugacacaaccaucacguauaacaauaccguugugaacaauauuacaaccacagucaucaacaaggcugaaaaacacuuuaagccuagccugccccucuguccuuucaaaggguuuuuccccuuucauaaggauaaugccauuagacugggagagaacaaggacgugaucguuacccgggaaccuuacguguccugcgauaaugacgauuguuggucuuucgcgcuugcucagggcgcccugcucgggacgaaacacagcaacggaacaaucaaggaccgcaccccguauagaucccugauucgguuucccaucggcacagccccuguccugggcaauuacaaagagauuugcguggcuuggucuagcuccagcuguuucgaugggaaggaauggaugcaugugugcaugaccggaaacgacaacgaugccucuggccagaucauuuaugcugggaaaaugaccgacuccaucaagagcuggcgcagagauauccuccggacacaggagucugagugucaaugcauugacggaacguguaucgucgccguuaccgauggccccgcggccaauuccgcugaccaccgcauuuacuggaucagagaagggaagauuaucaaauaugagaacaucccuaagacaaaaauucagcaccuggaagagugcagcuguuacguggacaccgauguguacugcaucugccgggacaauuggaagggaucuaaccgccccuggaugagaauuaauaacgagacaauccuugaaaccggcuaugucuguuccaaauuucauagcgauacgccgcggccugccgaccccuccacagugucuugcgauagcccuuccaauauuaacggcgggcccggaguuaagggcuucggguuucgcaccggaaaugacguguggcugggcagaaccgucagcacaaccgggcggucuggauucgaggugaucaaaguuacagaaggcuggauuaacucccucaaucacgcuaagagcgugacgcagacccuggucucuaacagcgauugguccggcuacucugggagcuuuaucguggagaauaacggauguuuccagcccugcuucuauaucgaacuuauucgcggcagaccuaauaagaacgacgaugucuccuggacaagcaacucuaucgugaccuuuugugggcuggacaaugagccgggauccggcaacuggcccgaugggagcaauauuggcuucaugccuaaauga

SEQ ID NO: 206634 - RNA, 1410 nt, Artificial Sequence; identical to SEQ ID NO: 206633
  derived and/or modified sequence opt5 from neuraminidase__InfluenzaA__AGQ81846

SEQ ID NO: 206635 - RNA, 1410 nt, Artificial Sequence; identical to SEQ ID NO: 206633
  derived and/or modified sequence opt5 from neuraminidase__InfluenzaA__AGQ81847

SEQ ID NO: 206636 - RNA, 1410 nt, Artificial Sequence
  derived and/or modified sequence opt5 from neuraminidase__InfluenzaA__AGQ81848
augaaccccaaucagaagaucauuaccaucggcguggucaacacaacgcugagcaccauugcccuccugaucgggauuggaaaucuuaucuucaacacaguuauccacgagaaaauuggcgugcaucaaaccgugaucuacccuacaauuaccuccccggucgugcccaauugcucugacacaaccaucacguauaacaauaccguugugaacaauauuacaaccacagucaucaacaaggcugaaaaacacuuuaagccuagccugccccucuguccuuucaaaggguuuuuccccuuucauaaggauaaugccauuagacugggagagaacaaggacgugaucguuacccgggaaccuuacguguccugcgauaaugacgauuguuggucuuucgcgcuugcucagggcgcccugcucgggacgaaacacagcaacggaacaaucaaggaccgcaccccguauagaucccugauucgguuucccaucggcacagccccuguccugggcaauuacaaagagauuugcguggcuuggucuagcuccagcuguuucgaugggaaggaauggaugcaugugugcaugaccggaaacgacaacgaugccucuggccagaucauuuaugcugggaaaaugaccgacuccaucaagagcuggcgcagagauauccuccggacacaggagucugagugucaaugcauugacggaaucuguauugucgccguuacggauggccccgcggccaauuccgcugaccaccgcaucuacuggauuagagaagggaagaucaucaaauaugagaacauuccuaagaccaaaauccagcaccuggaagagugcagcuguuacguggacacagauguguacugcauuugccgggacaauuggaagggaucuaaccgccccuggaugagaaucaauaacgagaccauucuugaaacaggcuaugucuguuccaaauuucauagcgauaccccgcggccugccgaccccuccacggugucuugcgauagcccuuccaauaucaacggcgggcccggaguuaagggcuucggguuucgcacaggaaaugacguguggcugggcagaaccgucagcaccacagggcggucuggauucgaggugauuaaaguuaccgaaggcuggaucaacucccucaaucacgcuaagagcgugacacagacgcuggucucuaacagcgauugguccggcuacucugggagcuuuaucguggagaauaacggauguuuccagcccugcuucuauauugaacuuauccgcggcagaccuaauaagaacgacgaugucuccuggaccagcaacucuauugugacauuuugugggcuggacaaugagccgggauccggcaacuggcccgaugggagcaauaucggcuucaugccuaaauga

SEQ ID NO: 206637 - RNA, 1410 nt, Artificial Sequence
  derived and/or modified sequence opt5 from neuraminidase__InfluenzaA__AGQ81850
augaaccccaaucagaagaucauuaccaucggcguggucaacacaacgcugagcaccauugcccuccugaucgggauuggaaaucuuaucuucaacacaguuauccacgagaaaauuggcgugcaucaaaccgugaucuacccuacaauuaccuccccggucgugcccaauugcucugacacaaccaucacguauaacaauaccguugugaacaauauuacaaccacagucaucaacaaggcugaaaaacacuuuaagccuagccugccccucuguccuuucaaaggguuuuuccccuuucauaaggauaaugccauuagacugggagagaacaaggacgugaucguuacccgggaaccuuacguguccugcgauaaugacgauuguuggucuuucgcgcuugcucagggcgcccugcucgggacgaaacacagcaacggaacaaucaaggaccgcaccccguauagaucccugauucgguuucccaucggcacagccccuguccugggcaauuacaaagagauuugcguggcuuggucuagcuccagcuguuucgaugggaaggaauggaugcaugugugcaugaccggaaacgacaacgaugccaccggccagaucauuuaugcugggaaaaugacagacucuaucaaguccuggcgcagagauauccuccggacgcaggagagcgagugucaaugcauugacggaaccuguaucgucgccguuacagauggccccgcggccaauucugcugaccaccgcauuuacuggaucagagaagggaagauuaucaaauaugagaacaucccuaagaccaaaauucagcaccuggaagagugcuccuguuacguggacacagauguguacugcaucugccgggacaauuggaagggaagcaaccgccccuggaugagaauuaauaacgagaccauccuugaaacgggcuaugucuguucuaaauuucauuccgauacaccgcggccugccgaccccagcaccguguccugcgauucuccuagcaauauuaacggcgggcccggaguuaagggcuucggguuucgcaccggaaaugacguguggcugggcagaacagucuccaccacagggcggagcggauucgaggugaucaaaguuacggaaggcuggauuaacucucucaaucacgcuaaguccgugacccagacacuggucagcaacucugauuggagcggcuacuccgggucuuuuaucguggagaauaacggauguuuccagcccugcuucuauaucgaacuuauucgcggcagaccuaauaagaacgacgaugucagcuggaccuccaacagcaucgugacauuuugugggcuggacaaugagccgggaucuggcaacuggcccgauggguccaauauuggcuucaugccuaaauga

SEQ ID NO: 206638 - RNA, 1410 nt, Artificial Sequence
  derived and/or modified sequence opt5 from neuraminidase__InfluenzaA__AGQ81852
augaaccccaaucagaagaucauuaccaucggcguggucaacacaacgcugagcaccauugcccuccugaucgggauuggaaaucuuaucuucaacacaguuauccacgagaaaauuggcgugcaucaaaccgugacauacccuaccaucacauccccggucgugcccaauugcucugacaccacgauuaccuauaacaauacaguugugaacaauaucaccacaaccgucauuaacaaggcugaaaaacacuuuaagccuagccugccccucuguccuuucaaaggguuuuuccccuuucauaaggauaaugccaucagacugggagagaacaaggacgugauuguuacgcgggaaccuuacguguccugcgauaaugacgauuguuggucuuucgcgcuugcucagggcgcccugcucgggacaaaacacagcaacggaaccaucaaggaccgcacaccguauagaucccugauccgguuucccauuggcaccgccccuguccugggcaauuacaaagagaucugcguggcuuggucuagcuccagcuguuucgaugggaaggaauggaugcaugugugcaugaccggaaacgacaacgaugccacaggccagauuaucuaugcugggaaaaugacggacucuauuaaguccuggcgcagagauauccuccggacccaggagagcgagugucaaugcaucgacggaacauguauugucgccguuaccgauggccccgcggccaauucugcugaccaccgcaucuacuggauuagagaagggaagaucauuaaauaugagaacaucccuaagacaaaaauccagcaccuggaagagugcuccuguuacguggacaccgauguguacugcauuugccgggacaauuggaagggaagcaaccgccccuggaugagaaucaauaacgagacgauucuugaaacaggcuaugucuguucuaaauuucauuccgauaccccgcggccugccgaccccagcaccguguccugcgauucuccuagcaauaucaacggcgggcccggaguuaagggcuucggguuucgcacaggaaaugacguguggcugggcagaaccgucuccacaacggggcggagcggauucgaggugauuaaaguuaccgaaggcuggaucaacucucucaaucacgcuaaguccgugacacagacccuggucagcaacucugauuggagcggcuacuccgggucuuuuauuguggagaauaacggauguuuccagcccugcuucuauaucgaacuuauccgcggcagaccuaaucggaacgacgaugucagcuggacauccaacagcauugugaccuuuugugggcuggacaaugagccgggaucuggcaacuggcccgauggguccaauaucggcuucaugccuaaguga

SEQ ID NO: 206639 - RNA, 1410 nt, Artificial Sequence
  derived and/or modified sequence opt5 from neuraminidase__InfluenzaA__AGQ81853
augaaccccaaucagaagaucauuaccaucggcguggucaacacaacgcugagcaccauugcccuccugaucgggauuggaaaucuuaucuucaacacaguuauccacgagaaaauuggcgugcaucaaaccgugacauacccuaccaucacauccccggucgugcccaauugcucugacaccacgauuaccuauaacaauacaguugugaacaauaucaccacaaccgucauuaacaaggcugaaaaacacuuuaagccuagccugccccucuguccuuucaaaggguuuuuccccuuucauaaggauaaugccaucagacugggagagaacaaggacgugauuguuacgcgggaaccuuacguguccugcgauaaugacgauuguuggucuuucgcgcuugcucagggcgcccugcucgggacaaaacacagcaacggaaccaucaaggaccgcacaccguauagaucccugauccgguuucccauuggcaccgccccuguccugggcaauuacaaagagaucugcguggcuuggucuagcuccagcuguuucgaugggaaggaauggaugcaugugugcaugaccggaaacgacaacgaugccacaggccagauuaucuaugcugggaaaaugacggacucuauuaaguccuggcgcagagauauccuccggacccaggagagcgagugucaaugcaucgacggaacauguauugucgccguuaccgauggccccgcggccaauucugcugaccaccgcaucuacuggauuagagaagggaagaucauuaaauaugagaacaucccuaagacaaaaauccagcaccuggaagagugcuccuguuacguggacaccgauguguacugcauuugccgggacaauuggaagggaagcaaccgccccuggaugagaaucaauaacgagacgauucuugaaacaggcuaugucuguucuaaauuucauuccgauaccccgcggccugccgaccccagcaccguguccugcgauucuccuagcaauaucaacggcgggcccggaguuaagggcuucggguuucgcacaggaaaugacguguggcugggcagaaccgucuccacaacggggcggagcggauucgaggugauuaaaguuaccgaaggcuggaucaacucucucaaucacgcuaaguccgugacacagacccuggucagcaacucugauuggagcggcuacuccgggucuuuuauuguggagaauaacggauguuuccagcccugcuucuauaucgaacuuauccgcggcagaccuaauaagaacgacgaugucagcuggacauccaacagcauugugaccuuuugugggcuggacaaugagccgggaucuggcaacuggcccgauggguccaauaucggcuucaugccuaaauga

SEQ ID NO: 206640 - RNA, 1410 nt, Artificial Sequence; identical to SEQ ID NO: 206639
  derived and/or modified sequence opt5 from neuraminidase__InfluenzaA__AGQ81854

SEQ ID NO: 206641 - RNA, 1410 nt, Artificial Sequence; identical to SEQ ID NO: 206639
  derived and/or modified sequence opt5 from neuraminidase__InfluenzaA__AGQ81855

SEQ ID NO: 206642 - RNA, 1410 nt, Artificial Sequence; identical to SEQ ID NO: 206632
  derived and/or modified sequence opt5 from neuraminidase__InfluenzaA__AGQ81856

SEQ ID NO: 206643 - RNA, 1410 nt, Artificial Sequence
  derived and/or modified sequence opt5 from neuraminidase__InfluenzaA__AGQ81857
augaaccccaaucagaagaucauuaccaucggcguggucaacacaacgcugagcaccauugcccuccugaucgggauuggaaaucuuaucuucaacacaguuauccacgagaaaauuggcgugcaucaaaccguggucuacccuacaaucaccccgcccgugauuccuaauugcuccgacacaaccaucacguauaacaauaccguugugaacaauauuacaaccacaaucauuaacaaggcugaaaaacaguuuaagcccucucugccucucugucccuucagaggguuuuucccuuuucacaaagauaaugccauccggcugggagagaacaaggacgucaucgugacccgcgaaccguacguuagcugcgauaaugacgauuguugguccuucgcgcuugcucagggcgcccugcucgggacgaagcauucuaacggaacaauuaaagacagaacccccuaucggagccugauccgcuuuccuauuggcacagcccccgugcugggcaauuacaaggagaucugcgucgcuugguccucuagcuccuguuucgaugggaaagaauggaugcacgugugcaugaccggaaacgacaacgaugccagcggccagauuaucuaugcugggaagaugaccgacucuaucaaauccuggagacgggauauucuccgcacacaagagagcgagugucagugcaucgacggaacguguauuguggccgucaccgauggcccugcggccucuuccgcugaccauagaaucuacuggauucgggaagggaagaucaucaaguaugaggacauucccaaaacaaagauccagcaccuggaagagugcagcuguuacguugauaccgacguguacugcauuugccgcgauaauuggaaaggaucuaacagaccguggaugcggaucaauaacgagacaauucuugaaaccggcuauguguguuccaaguuucacagcgacacgccucgccccgccgauccuuccacagucucuugcgacagccccuccaauaucaacggcgggcccggagugaaaggcuucggguuuagagcuggaaaugauguuuggcugggccggaccgugagcaccacagggcgcucuggauucgaggucauuaaggugaccgaaggcuggaucaacucccucaaucaugccaaaagcguuacacagacgcuggugucuaacaaugacuggagcggcuacuccgggucuuuuaucgucgagagcaacggauguuuccaaccuugcuucuauauugaacuuaucagaggccggccgaauagaaacgaugacguguccuggaccagcaauucuauugucacauuuugugggcuggauaacgagcccggauccggcaacuggccugacgggagcaauaucggcuucaugcccaaguga

SEQ ID NO: 206644 - RNA, 1410 nt, Artificial Sequence
  derived and/or modified sequence opt5 from neuraminidase__InfluenzaA__AGQ81858
augaaccccaaucagaagaucauuaccaucggcguggucaacacaacgcugagcaccauugcccuccugaucgggguuggaaaucuuauuuucaacacagugauccacgagaaaaucggcgaccaucaaauuguggucuacccuaccacaaccgcuuccgugguuccgaauugcucugauacaaucauuaccuauaacaauacgguggucaacaauaucaccacaaccauuaucacaaaggaagagacccacuuuaaaagcucccugccccucuguccuuucagaggguuuuuccccuuucauaaggacaacgccauucggcugggagaaaauaaagaugugaucguuacgcgcgagccuuacgugucuugcgacaacgaugacuguuggagcuucgcgcuugcucagggcgcccugcucgggacaaagcacuccaauggaaccaucaaggauagaacacccuaucggucucugauucgcuuuccuaucggcaccgccccgguccugggcaacuacaaagaaauuugcguggcuuggagcuccagcucuuguuucgacgggaaggaguggaugcaugugugcaugaccggaaaugauaacgacgccuccggccagaucauguaugcugggaaaaugacagauagcauuaagucuuggagaaaagacauccuccggacgcaggaguccgaaugucaaugcaucgauggaaccuguauugucgccguuacagacggccccgcgaccaacagcgccgaccaccgcaucuacuggauuagagaggggaagaucauuaaguaugaaaauaucccuaaaacaaagauccagcaccuggaggagugcucuuguuacguggauauugacguguacugcgucugccgggauaacuggaaaggauccaaucgccccuggaugagaaucaacaaugaaaccauucuugagacgggcuauguguguagcaaguuucauuccgacacaccucggcccgcugauccgucuaccguuagcugcgacuccccuagcaacgugaauggcgggcccggagucaaaggcuucggguuuaagaccggaaacgauguguggcugggccgcacaguuucuaccuccgggagaagcggauucgaaaucauuaaagugacagagggcuggaucaauucuccuaaccacgccaagagcgucacgcagacccucguguccaauaacgacuggucuggcuacagcggguccuuuauugucgaaaauaacggauguuuccagcccugcuucuauaucgagcugauccggggccgccccaauaagaacgaugacgugagcuggacaucuaacuccauuguuaccuuuugugggcuugauaaugagccuggaagcggcaacuggccggacgggucuaauaucggcuucaugcccaaauga

SEQ ID NO: 206645 - RNA, 1410 nt, Artificial Sequence
  derived and/or modified sequence opt5 from neuraminidase__InfluenzaA__AGQ81859
augaaccccaaucagaagaucauuaccaucggcguggucaacacaacgcugagcaccauugcccuccugaucgggauuggaaaucuuaucuucaacacaguuauccacgagaaaauuggcgugcaucaaaccguggucugcccuacaaucaccccgcccgugguuccuaauuguuccgacacaaccauuacguacaacaauaccguggucaacaauaucacaaccacaauuaucaacaaggcugaaaaacaguuuaagucuagccugccccucugcccuuucagaggguuuuuccccuuucacaaagauaaugccauucggcugggagagaacaaggacgugaucguuacccgcgaaccuuauguguccugugauaaugacgauugcuggucuuucgcgcuugcucagggcgcccugcucgggacgaagcauagcaacggaacaaucaaagacagaaccccguaccggucccugauucgcuuucccaucggcacagccccuguccugggcaauuauaaggagauuuguguggcuuggucuagcuccagcugcuucgaugggaaagaauggaugcacaucuguaugaccggaaacgacaacgaugccucuggccagauuaucuacgcugggaagaugaccgacuccaucaaaagcuggagacgggauauucuccgcacacaagagucugagugccaguguaucgacggaacgugcauuguggccaucaccgauggccccgcggccuccagcgcugaccauagaauuuauuggauccgggaagggaagaucauuaaguacgagaauaucccuaaaacaaagauucagcaccuggaagaguguucuugcuaugucgacaucgauguuuacugcauuugucgcgacaacuggaaaggauccaauagacccuggaugcggaucaacaaugagaccauucuugaaacaggcuacgugugcagcaaguuucacuccgauaccccgcgcccugccgaccccucuacggugagcugugauuccccuagcaacaucaauggcgggcccggagucaaaggcuucggguuuagagcuggaaacgacguguggcugggccggacaguuucuaccaccgggcgcuccggauucgaggugaucaaggucacagaaggcuggauuaauagccucaaccaugccaaaucugugacccagacacugguuagcaauuccgauuggucuggcuauagcggguccuuuaucguggagaacaauggaugcuuccaacccuguuucuacauugaacuuaucagaggccggccuaacagaaaugacgaugucagcuggacgucuaacuccauugugaccuuuugcgggcuggacaacgagccgggaagcggcaauuggcccgaugggucuaacaucggcuucaugccuaaguga

SEQ ID NO: 206646 - RNA, 1413 nt, Artificial Sequence
  derived and/or modified sequence opt5 from neuraminidase__InfluenzaA__AGQ81860
augaaccccaaucagaagaucauuugcaucagcgccaccggcaugacacuguccguggucucucuccugauugggaucgcuaaccuuggacugaauauuggccuccacuacaaaguuggggacacgccugaugugagcaucccgaacaugaaugagaccaacuccacaaccacaaucauuaauaacaauacccaaaacaauuucacaaacaucaccaauauuaucgugaacaagaaugaagagaaaacguuucugaaccuuaccaagccccugugugaagucaacucuuggcauauucucagcaaagacaaugccaucagaauuggagaggaugcgcacauccuggugacacgggaaccuuaucuguccugcgacccccagggcugucgcauguucgcucucucucaggggaccacacugagaggacggcaugccaacggcaccauccacgaucgcagcccuuuuagagcccuuguuuccugggagaugggccaggcucccagcccuuacaaugugaaggucgagugcgugggguggucuuccacgagcugucaugacggaauuucucggauguccaucugcaugagcggcccgaacaauaacgccucugcuguugugugguaugggggacgccccgucacagaaauuccuuccugggccggcaauauccugagaacccaagagagcgaaugugugugccacaaggggauuugucccguggucaugacagauggaccugcgaacaaucgggccgcuaccaaaaucaucuacuucaaggagggcaaaauucagaagaucgaggaacucgccggcuccgcucagcacauugaggaaugcucuuguuauggggccguugaggugaucaaaugcauuugccgcgacaacuggaagggagcgaauagacccgugaucaccaucaacccggaaaugaugacacauacgagcaaguaccuguguuccaaaguccuuaccgauacaagccggccuaaugaccccaccaacggcaauugcgaugccccuauuacagggggaucucccgaccccggcgugaagggguuugcuuuccuggauggagagaacuccuggcucggccgcaccaucagcaaagacucuagaagcggcuaugagaugcugaagguuccuaacgccgaaacggacacacaguccgggccgaccucucaccaagugauugucaauaaccagaauuggagcggauacuccggcgcuuuuaucgauuacugggccaacaaagaguguuucaaucccugcuuuuauguggaacugauucgggggcgcccuaaggagagcucuguucucuggaccuccaacagcaucguggcccuguguggaucuaaagaaagacuuggcuccuggagcuggcaugacggggcugagauuaucuacuucaaguga

SEQ ID NO: 206647 - RNA, 1413 nt, Artificial Sequence
  derived and/or modified sequence opt5 from neuraminidase__InfluenzaA__AGQ81861
augaaccccaaucagaagaucauuugcaucagcgccaccggcaugacacuguccguggucucucuccugauugggaucgcuaaccuuggacugaauauuggccuccacuacaaaguuggggacacgccugaugugagcaucccgaacaugaaugagaccaacuccacaaccacaaucauuaauaacaauacccaaaacaauuucacaaacaccacgaauaucauugugaacaagaaugaagagaaaaccuuucugaaccuuacaaagccccugugugaagucaacucuuggcauauccucagcaaagacaaugccauuagaaucggagaggaugcgcacauucuggugacccgggaaccuuaucuguccugcgacccccagggcugucgcauguucgcucucucucaggggacaacccugagaggacggcaugccaacggcacgauccacgaucgcagcccuuuuagagcccuuguuuccugggagaugggccaggcucccagcccuuacaaugugaaggucgagugcgugggguggucuuccacaagcugucaugacggaaucucucggauguccauuugcaugagcggcccgaacaauaacgccucugcuguugugugguaugggggacgccccgucaccgaaaucccuuccugggccggcaauauucugagaacacaagagagcgaaugugugugccacaaggggaucugucccguggucaugaccgauggaccugcgaacaaucgggccgcuaccaaaauuaucuacuucaaggagggcaaaauccagaagauugaggaacucgccggcuccgcucagcacaucgaggaaugcucuuguuauggggccguugaggugauuaaaugcaucugccgcgacaacuggaagggagcgaauagacccgugauuacaaucaacccggaaaugaugacgcauaccagcaaguaccuguguuccaaaguccuuacagauaccagccggccuaaugaccccacaaacggcaauugcgaugccccuaucaccgggggaucucccgaccccggcgugaagggguuugcuuuccuggauggagagaacuccuggcucggccgcacgauuagcaaagacucuagaagcggcuaugagaugcugaagguuccuaacgccgaaacagacacccaguccgggccgaccucucaccaagugaucgucaauaaccagaauuggagcggauacuccggcgcuuuuauugauuacugggccaacaaagaguguuucaaucccugcuuuuauguggaacugauccgggggcgcccuaaggagagcucuguucucuggacauccaacagcauuguggcccuguguggaucuaaagaaagacuuggcuccuggagcuggcaugacggggcugagaucauuuacuucaaguga

SEQ ID NO: 206648 - RNA, 1413 nt, Artificial Sequence
  derived and/or modified sequence opt5 from neuraminidase__InfluenzaA__AGQ81862
augaaccccaaucagaagaucauuugcaucagcgccaccggcaugacacuguccguggucucucuccugauugggaucgcuaaccuuggacugaauauuggccuccacuacaaaguuggggacacgccugaugugaacaucccgagcaugaaugagaccaacuccacaaccacaaucauuaauaacaauacccaaaacaauuucacaaacaucaccaauauuaucgugaacaaggaagagggaagaacguuucugaaucuuaccaaaccccugugugaagucaacucuuggcauauucucagcaaggacaacgccauccggauuggcgaggaugcgcacauccuggugacacgcgaaccuuaucuguccugcgacccccagggguguagaauguucgcucucucucagggaaccacacugcggggccgccaugccaauggcaccauccacgauagaagcccuuuucgggcccuuguuuccugggagauggggcaggcucccagcccuuacaacgugcgcgucgagugcauuggauggucuuccacgagcugucaugacggcaucucuagaauguccauuugcaugagcgggccgaauaacaaugccucugcugugguuugguauggaggccggcccgugacagaaaucccuuccugggccgggaacauucugcgcacccaagagagcgaaugugucugccacaaaggaaucugucccguggugaugacagauggcccugcgaauaacagagccgcuaccaagaucauuuacuucaaggagggcaaaauccagaagauugaggaacucgaggggaaugcccagcacaucgaagagugcuccuguuauggagcugccggcgucauuaaaugcaucugccgggacaacuggaagggggcgaaucgccccguuaucauuaucgauccggaaaugaugacccauacaucuaaauaccuguguagcagagugcuuacggacaccucccggccuaacgaucccacaagcggaaauugcgacgccccuauuaccggcgggucucccgaucccggagugaagggcuuugcuuuccuggacggcgagaacuccuggcucgggcgcacaaucagcaaggacucuagaagcggauaugagaugcugaaagucccuaaugccgaaaccgauacgcaguccggcccgacaucucaccaagugauuguuaacaaccagaauuggagcggguacuccggagcuuuuaucgacuacugggccaacaaggaguguuucaaucccugcuuuuauguggaacugauucggggcagaccuaaagagagcucuguccucuggaccuccaacagcaucguggcccugugugggucuaaggaacgccuuggcuccuggagcuggcaugauggagcugagaucauuuacuucaaauga

SEQ ID NO: 206649 - RNA, 1413 nt, Artificial Sequence
  derived and/or modified sequence opt5 from neuraminidase__InfluenzaA__AGQ81863
augaaccccaaucagaagaucauuugcaucagcgccaccggcaugacacuguccguggucucucuccugauugggaucgcuaaccuuggacugaauauuggccuccacuacaaaguuggggacacgccugaugugaacaucccgagcaugaaugagaccaacuccacaaccacaaucauuaauaacaauacccaaaacaauuucacaaacaucaccaauauuaucgugaacaaggaagaggaaagaacguuucugaaucuuaccaaaccccugugugaggucaacucuuggcauauucucagcaaggacaacgccauccggauuggagaagaugcgcacauccuggugacacgcgagccuuaucuguccugcgacccccagggcuguagaauguucgcucucucucaggggaccacacugcggggacgccaugccaauggcaccauccacgauagaagcccuuuucgggcccuuguuuccugggagaugggccaggcucccagcccuuacaacgugcgcgucgaaugcauuggguggucuuccacgagcugucaugacggaaucucuagaauguccauuugcaugagcggcccgaauaacaaugccucugcugugguuugguaugggggacggcccgugacagagaucccuuccugggccggcaacauucugcgcacccaagaaagcgagugugucugccacaaagggaucugucccguggugaugacagauggaccugcgaauaacagagccgcuaccaagaucauuuacuucaaggagggcaaaauccagaagauugaggaacucgaaggcaaugcccagcacaucgaggaaugcuccuguuauggggcugccggagucauuaaaugcaucugccgggacaacuggaagggcgcgaaucgccccguuaucauuaucgauccggagaugaugacccauacaucuaaauaccuguguagcagagugcuuacggacaccucccggccuaacgaucccauuagcgggaauugcgacgccccuaucacaggaggcucucccgaucccggggugaagggauuugcuuuccuggacggcgagaacuccuggcucggccgcaccauuagcaaggacucuagaagcggguaugaaaugcugaaagucccuaaugccgagacagauacccaguccggaccgacgucucaccaagugaucguuaacaaccagaauuggagcggcuacuccggggcuuuuauugacuacugggccaacaaggaauguuucaaucccugcuuuuauguggagcugauccggggaagaccuaaagaaagcucuguccucuggacauccaacagcaucguggcccuguguggcucuaaggagcgccuuggguccuggagcuggcaugauggcgcugagauuaucuacuucaaauga

SEQ ID NO: 206650 - RNA, 1416 nt, Artificial Sequence
  derived and/or modified sequence opt5 from neuraminidase__InfluenzaA__AGQ81864
augaaccccaaucagaagcuguucgcccucagcggcguggcuaucgcccuguccguccuuaaccugcucauugggaucucuaauguuggacugaacgugagccuucaccugaaagagaagggcccuaaacaagaagaaaauucuaccugcacaacgauuaaccagaauaacaccacaaucguggagaauaccuacgucaacaauacaaccauuaucuccaaggagacagaacucaaaccgcccaacuaucugcugcucaauaagagccuguguaacguggagggguggguugugaucgcgaaggacaaugcugucagauuuggagaguccgaacagauuaucgugacccgggagccuuacguuucuugcgaucccacgggcuguaaaauguaugcccuucaucaggggaccacaauucgcaacaagcacagcaacggaaccauccaugacagaacagccuuccggggccugauuuccaccccucucggcacgcccccuacagugagcaauucugauuuuaucugcgucgggugguccagcaccacaugucacgacggaauuggccgcaugaccaucugcauccaagggaacaaugauaacgcuaccgccacaguguacuauaauagacggcugacgaccacaauuaaaaccugggcucgcaacauccuuagaacacaggaaucugagugugugugccauaauggaaccugugccgucguuaugacggacggcuccgcgagcucucaggccuacacaaaggugauguauuuccacaaagggcuggugauuaaggaggaagcucucaagggauccgcccggcacaucgaggaaugcagcuguuacggccauucccagaaagcuaccugcgucugccgcgauaacuggcaaggcgccaauagaccgauuaucgagaucgacaugaacacccuggaacacacaucucgguacguguguaccgggauucugacagauacgagccgccccggagacaaguccagcggcgauugcucuaauccuaucaccgggucccccggagcgccuggcguuaaaggguuuggauuccucaacggcgacaauacauggcugggcagaaccauuagccccaagucucggagcggguuugagaugcuuaaaaucccgaacgccggaacagauccuaauucccgcauugcugagagacaggaaaucguggacaacaacaauuggucuggcuauagcggguccuucaucgacuacugggauaacgacagcgaguguuauaaucccugcuuuuacgucgaacugauucggggaagaccugaggaagccaaguaugugugguggaccucuaacucccucaucgcucuguguggcagccccuuccccguugggucuggcuccuuuccugauggagcccagauucaguacuucagcuga

SEQ ID NO: 206651 - RNA, 1416 nt, Artificial Sequence
  derived and/or modified sequence opt5 from neuraminidase__InfluenzaA__AGQ81865
augaaccccaaucagaagcuguucgcccucagcggcguggcuaucgcccuguccguccuuaaccugcucauugggcugucuaauguuggacuuaacgugagccugcaccucaaagagaccggcccuaagcaagaagggaaucugacaugcaugacgaucaaccagaauaacaccacaguggucgagaauaccuacgugaacaauacaaccauuaucacaaaagaaaccgaguccgaaacgccgaacuaucugcuccugaauaagucucuuuguaacguugagggauggguggucauugcgaaagacaaugcugugagauuuggcgagagcgaacagaucaucguuacccgggagcccuacguguccugcgauccuaacggguguaagauguaugcccugcaucagggaacaaccauucgcaacaagcacucuaauggcacaauccaugacagaaccgccuuccggggccucauuagcacgccccuggggacaccucccaccgucuccaacagcgauuuuaucugcgugggauggucuuccacaaccugucacgacggcauugggcgcaugaccaucugcauucaaggaaauaacgauaaugcuacagccacgguguacuauaacagacggcuuaccacaaccaucaaaacaugggcucgcaauauccugagaacccaggaaagcgagugugucugccauaacggcacgugugccguugugaugacagacgggucugcguccagccaggcccacaccaaggugauguacuuccacaaaggacucgucgugaaggaggaagcucugaaaggcucugcccggcauauugaggaaugcuccuguuauggccacaaucagaagguuaccugcgugugccgcgauaacuggcaaggggcuaauagaccuaucauugagaucgacaugaacacacuggaacauaccagccgguacgucuguacaggcauucucacggauaccucccgcccgggagacaagcccacaggggauugcucuaauccuaucaccggaagccccggcgccccuggggugaaaggauuuggcuuccugaacggcgggaauacauggcuuggaagaaccaucagcccccggucccgcucuggcuuugagaugcugaagauuccgaacgcggggacggacccuaacuccagaaucgccgagcggcaggaaauuguugauaauagcaacuggucuggauacagcggcuccuucaucgacuauuggaaugacaacucugaguguuacaaucccugcuuuuauguggaacucauuagagggcgcccugaggaagcuaaauacgucugguggaccagcaacucccugaucgcccuuuguggcagccccuuccccgugggaucuggcuccuuuccugauggggcucagauccaguauuucagcuga

SEQ ID NO: 206652 - RNA, 1416 nt, Artificial Sequence
  derived and/or modified sequence opt5 from neuraminidase__InfluenzaA__AGQ81868
augaaccccaaucagaagcuguucgcccucagcggcguggcuaucgcccuguccguccuuaaccugcucauugggaucucuaauguuggacugaacgugagccuucaccugaaagagaagggcccuaaacaagaagagaauagcacaugcaccacgauuaaccagaauaacaccacaguggucgaaaauaccuacgugaacaauacaaccaucauuacaaaggagaccgaacucaaaacgccgucuuaucugcugcucaacaagagccuguguaauguugagggguggguggucaucgcgaaggacaacgcugugagauuuggagaguccgaacagaucauuguuacccgggagcccuacgugucuugcgauccuacaggcuguaaaauguaugcccuucaucaggggaccacaauccgcaauaagcacagcaacggaaccauucaugacagaacggccuuccggggccugaucuccacaagccucggcacacccccuaccauuucuaacuccgauuuuaugugcgucggguggagcucuaccaccugucacgacggaaucggccgcaugacaauuugcauccaagggaauaacgauaaugcuacggccaccguguacuauaacagacggcugacaaccacaaucaaaaccugggcucgcaauauucuuagaacgcaggaauccgagugugugugccauaacggaaucugugccgucguuaugacagacggcagcgcgucuucccaggccuacaccaaggugauguauuuccacaaagggcugguggucaaggaggaagcucucaagggaagcgcccggcacauugaggaaugcuccuguuacggccauucucagaaagugaccugcguuugccgcgauaauuggcaaggcgcuaacagacccaucauugagaucgacaugaauacacuggaacacaccagccgguacguguguacagggauccugacggauaccucccgcccuggagacaagagcucuggcgauugcuccaacccgauugccgggagccccggagcgccuggcgucaaaggguuuggauuccucaauggcgacaacacauggcugggcagaaccaucucuccccggagccgcuccggguuugagaugcuuaagauuccuaaugccggaacagaucccaacucuagaaucgcuggccggcaggagauuguggacaauaacaacuggagcggguauuccggauccuucaucgacuacuggaaugauaacucugaauguuauaauccgugcuuuuacguugagcugaucagaggccgcccugaagaggccaaauaugugugguggaccuccaacagccucauugcucugugugggucucccuucccugucggcuccggcagcuuucccgacggagcccagauccaguacuucuccuga

SEQ ID NO: 206653 - RNA, 1416 nt, Artificial Sequence
  derived and/or modified sequence opt5 from neuraminidase__InfluenzaA__AGQ81869
augaaccccaaucagaagcuguucgcccucagcggcguggcuaucgcccuguccguccuuaaccugcucauugggaucucuaauguuggacugaacgugagccuucaccugaaagagaagggcccuaaacaagaagaaaauucuaccugcacaacgauuaaccagaauaacaccacaaucguggagaauaccuacgucaacaauacaaccauuaucuccaaggagacagaacucaaaaccccgagcuaucugcugcucaacaagucccuguguaauguggagggguggguugugaucgcgaaggacaacgcugucagauuuggagagucugaacagauuaucgugacgcgggagcccuacguuagcugcgauccuaccggcuguaaaauguaugcccuucaucaggggacaaccauucgcaauaagcacuccaacggaacaauccaugacagaaccgccuuccggggccugauuagcacgccccucggcacaccucccaccgugucuaacuccgauuuuaucugcgucggguggagcucuacaaccugucacgacggaauuggccgcaugaccaucugcauccaagggaauaacgauaaugcuacagccacgguguacuauaacagacggcugaccacaaccauucgcacaugggcuagaaauauccuucggacccaggaauccgagugugugugccauaacggaacgugugccgucguuaugacagacggcagcgcgucuucccaggccuacaccaaagugauguauuuccacaaggggcuggugauuaaagaggaagcucucaagggaagcgcccgccacaucgaggaaugcuccuguuacggccauucucagaaggcuaccugcgucugcagagauaauuggcaaggcgccaaccggccuauuaucgagaucgacaugaauacacuggaacacaccagccgcuacguguguacagggauucugacggauaccuccagaccgggagacaaaagcucuggcgauugcuccaaccccaucacagggagcccuggagcgcccggcguuaagggguuuggauuccucaauggcgacaacaccuggcugggccggacaauuucuccucgcagcagauccggguuugagaugcuuaaaauccccaaugccggaaccgauccgaacucucggauugcugagagacaggaaaucguggacaauaacaacuggagcggcuauuccgggagcuucaucgacuacuggaauaacgauucugaguguuauaauccuugcuuuuacgucgaacugauucgcggacggcccgaggaagccaaguaugugugguggacguccaacagccucaucgcucuguguggcucuccuuuccccguuggguccggcagcuuucccgacggagcccagauucaguacuucuccuga

SEQ ID NO: 206654 - RNA, 1416 nt, Artificial Sequence
  derived and/or modified sequence opt5 from neuraminidase__InfluenzaA__AGQ81870
augaaccccaaucagaagcuguucgcccucagcggcguggcuaucgcccuguccguccuuaaccugcucauugggaucucuaauguuggacugaacgugagccuucaccugaaagagaagggcccuaaacaagaagaaaauucuaccugcacaacgauuaaccagaauaacaccacaaucguggagaauaccuacgucaacaauacaaccauuaucuccaaggagacagaacucaaaccgcccagcuaucugcugcucaacaagucccuguguaauguggagggguggguugugaucgcgaaggacaacgcugucagauuuggagagucugaacagauuaucgugacccgggagccuuacguuagcugcgaucccacgggcuguaaaauguaugcccuucaucaggggaccacaauucgcaauaagcacuccaacggaaccauccaugacagaacagccuuccggggccugauuagcaccccucucggcacgcccccuacagugucuaacuccgauuuuaucugcgucggguggagcucuaccacaugucacgacggaauuggccgcaugaccaucugcauccaagggaauaacgauaaugcuaccgccacaguguacuauaacagacggcugacgaccacaauucgcaccugggcuagaaauauccuucggacacaggaauccgagugugugugccauaacggaaccugugccgucguuaugacggacggcagcgcgucuucccaggccuacacaaaagugauguauuuccacaaggggcuggugauuaaagaggaagcucucaagggaagcgcccgccacaucgaggaaugcuccuguuacggccauucucagaaggcuaccugcgucugcagagauaauuggcaaggcgccaaccggccgauuaucgagaucgacaugaauacccuggaacacacaagccgcuacguguguaccgggauucugacagauacguccagacccggagacaaaagcucuggcgauugcuccaacccuaucaccgggagccccggagcgccuggcguuaagggguuuggauuccucaauggcgacaacacauggcugggccggaccauuucuccccgcagcagauccggguuugagaugcuuaaaaucccgaaugccggaacagauccuaacucucggauugcugagagacaggaaaucguggacaauaacaacuggagcggcuauuccgggagcuucaucgacuacuggaauaacgauucugaguguuauaaucccugcuuuuacgucgaacugauucgcggacggccugaggaagccaaguaugugugguggaccuccaacagccucaucgcucuguguggcucucccuuccccguuggguccggcagcuuuccugacggagcccagauucaguacuucuccuga

SEQ ID NO: 206655 - RNA, 1416 nt, Artificial Sequence
  derived and/or modified sequence opt5 from neuraminidase__InfluenzaA__AGQ81871
augaaccccaaucagaagcuguucgcccucagcggcguggcuaucgcccuguccguccuuaaccugcucauugggaucucuaauguuggacugaacgugagccuucaccugaaagagaagggcccuaaacaagaagaaaauucuaccugcacaacgauuaaccagaauaacaccacaaucguggagaauaccuacgucaacaauacaaccauuaucuccaaggagacagaacucaaaaccccgagcuaucugcugcucaacaagucccuguguaauguggagggguggguugugaucgcgaaggacaacgcugucagauuuggagagucugaacagauuaucgugacgcgggagcccuacguuagcugcgauccuaccggcuguaaaauguaugcccuucaucaggggacaaccauucgcaauaagcacuccaacggaacaauccaugacagaaccgccuuccggggccugauuagcacgccccucggcacaccucccaccgugucuaacuccgauuuuaucugcauuggguggagcucuacaaccugucacgacggaaucggccgcaugaccaucugcauucaagggaauaacgauaaugcuacagccacggucuacuauaacagacggcugaccacaaccauccgcacaugggcuagaaauauucuucggacccaggaauccgagugugugugccauaacggaacgugugccguggucaugacagacggcagcgcgucuucccaggccuacaccaaaguuauguauuuccacaaggggcuggugaucaaagaggaagcucucaagggaagcgcccgccacauugaggaaugcuccuguuacggccauucucagaaggcuaccugcgugugcagagauaauuggcaaggcgccaaccggccuaucaucgagauugacaugaauacacuggaacacaccagccgcuacgucuguacagggauccugacggauaccuccagaccgggagacaaaagcucuggcgauugcuccaaccccauuacagggagcccuggagcgcccggcgugaagggguuuggauuccucaauggcgacaacaccuggcugggccggacaaucucuccucgcagcagauccggguuugagaugcuuaaaauucccaaugccggaaccgauccgaacucucggaucgcugagagacaggaaaucguugacaauaacaacuggagcggcuauuccgggagcuucauugacuacuggaauaacgauucugaguguuauaauccuugcuuuuacguggaacugauccgcggacggcccgaggaagccaaguaugucugguggacguccaacagccucauugcucuguguggcucuccuuuccccgugggguccggcagcuuucccgacggagcccagauccaguacuucuccuga

SEQ ID NO: 206656 - RNA, 1416 nt, Artificial Sequence
  derived and/or modified sequence opt5 from neuraminidase__InfluenzaA__AGQ81872
augaaccccaaucagaagcuguucgcccucagcggcguggcuaucgcccuguccguccuuaaccugcucauugggaucucuaauguuggacugaacgugagccuucaccugaaagagaagggcccuaaacaagaagaaaauucuaccugcacaacgauuaaccagaauaacaccacaaucguggagaauaccuacgucaacaauacaaccauuaucuccaaggagacagaacucaaaaccccgagcuaucugcugcucaacaagucccuguguaauguggagggguggguugugaucgcgaaggacaacgcugucagauuuggagagucugaacagauuaucgugacgcgggagcccuacguuagcugcgauccuaccggcuguaaaauguaugcccuucaucaggggacaaccauucgcaauaagcacuccaacggaacaauccaugacagaaccgccuuccggggccugauuagcacgccccucggcacaccucccucuguguccaacagcgauuuuaucugcgucggguggucuuccaccacaugucacgacggaauuggccgcaugaccaucugcauccaagggaauaacgauaaugcuaccgccacaguguacuauaacagacggcugacgaccacaauucgcaccugggcuagaaauauccuucggacacaggaaagcgagugugugugccauaacggaaccugugccgucguuaugacggacggcucugcguccagccaggccuacacaaaagugauguauuuccacaaggggcuggugauuaaagaggaagcucucaagggauccgcccgccacaucgaggaaugcucuuguuacggccauagccagaaggcuaccugcgucugcagagauaauuggcaaggcgccaaccggccuauuaucgagaucgacaugaauacccuggaacacacaucccgcuacguguguaccgggauucugacagauacgagcagaccgggagacaaaucuuccggcgauugcagcaaccccaucaccgggucuccuggagcgcccggcguuaagggguuuggauuccucaauggcgacaacacauggcugggccggaccauuagcccucgcuccagaucuggguuugagaugcuuaaaauccccaaugccggaacagauccgaacagccggauugcugagagacaggaaaucguggacaauaacaacugguccggcuauagcgggucuuucaucgacuacuggaauaacgauuccgaguguuauaauccuugcuuuuacgucgaacugauucgcggacggcccgaggaagccaaguaugugugguggaccagcaacucucucaucgcucuguguggcuccccuuuccccguugggagcggcuccuuucccgacggagcccagauucaguacuucucuuga

SEQ ID NO: 206657 - RNA, 1416 nt, Artificial Sequence
  derived and/or modified sequence opt5 from neuraminidase__InfluenzaA__AGQ81875
augaaccccaaucagaagcuguucgcccucagcggcguggcuaucgcccuguccguccuuaaccugcucauugggaucucuaauguuggacugaacgugagccuucaccugaaagagaagggcccuaaacaagaagaaaauucuaccugcaugacaauuaaccagaauaacacgaccguggucgagaauacauacgugaacaauaccacaaucauuaccaaggagacagaacucgagaccccguccuaucugcugcucaacaaagggcuguguaauguugagggauggguggucaucgcgaaggacaacgcugugagauuuggcgaaacggagcagaucauuguuacccgggaacccuacgugagcugcgauccuaauggguguaagauguaugcccuucaucagggaacaaccauccgcaacaaacacuccaacggcacaauucaugacagaaccgccuuccggggccugaucucuacgccccucgggacaccucccaccgucagcaauuccgauuuuauuugcgugggauggagcucuacaaccugucacgacggcaucgggcgcaugaccauuugcauccaaggaaacaaugauaacgcuacagccacgguguacuauaauagacggcugaccacaaccaucaagacaugggcucgcaacauucuuagaacccaggaguccgagugugucugccauaauggcacgugugccguugugaugacagacgggagcgcgucuucccaggcccacaccaaagugaucuacuuccacaagggacugauugucaaagaagaggcucucaagggcagcgcccggcauaucgaagagugcucuuguuauggccacucccagaaggugaccugcguuugccgcgauaacuggcaaggggcuaauagaccuauuaucgaaaucgacaugaacacacuggagcauaccagccgguacguguguacaggcauucugacggauaccucccgcccgggagacaaaucuacaggggauugcagcaaucccaucaccggauccccuggcgcccccggggucaagggauuuggcuaccucaacggcgacaauacauggcuggggagaaccauuagcccucggucucgcuccggauucgagaugcuuaaaauccccaacgcgggcacggauccgaauagcagaauuaccgaacggcaggagaucguggacaacaacaauuggucuggguauagcggauccuuuguugacuacuggaacgauaauucugaauguuauaacccuugcuucuacguggagcugaucagaggccgccccgaagaggccaaguaugucugguggacaagcaauuccauuaucgcucucugugggagcccuuuucccgugggcucuggauccuuccccgacggcgcccagauucaguacuuuagcuga

SEQ ID NO: 206658 - RNA, 1416 nt, Artificial Sequence
  derived and/or modified sequence opt5 from neuraminidase__InfluenzaA__AGQ81876
augaaccccaaucagaagcuguucgcccucagcggcguggcuaucgcccuguccguccuuaaccugcucauugggaucucuaauguuggacugaacgugagccuucaccugaaagagaagggcccuaaacaagaagaaaauucuaccugcaugacaauuaaccagaauaacacgaccguggucgagaauacauacgugaacaauaccacaaucauuaccaaggagacagaacucgagaccccguccuaucugcugcucaacaaagggcuguguaauguugagggauggguggucaucgcgaaggacaacgcugugagauuuggcgaaacggagcagaucauuguuacccgggaacccuacgugagcugcgauccuaauggguguaagauguaugcccuucaucagggaacaaccauccgcaacaaacacuccaacggcacaauucaugacagaaccgccuuccggggccugaucucuacgccccucgggacaccucccaccgucagcaauuccgauuuuauuugcgugggauggagcucuacaaccugucacgacggcaucgggcgcaugaccauuugcauccaaggagauaacgacaaugcuacagccacgguguacuauaacagacggcugaccacaaccaucaagacaugggcucgcaauauucuuagaacccaggaguccgagugugucugccauaacggcacgugugccguugugaugacagaugggagcgcgucuucccaggcccacaccaaagugaucuacuuccacaagggacugauugucaaagaagaggcucucaagggcagcgcccggcauaucgaagagugcucuuguuauggccacucccagaaggugaccugcguuugccgcgacaauuggcaaggggcuaacagaccuauuaucgaaaucgauaugaauacacuggagcauaccagccgguacguguguacaggcauucugacggacaccucccgcccgggagauaaaucuacaggggacugcagcaaccccaucaccggauccccuggcgcccccggggucaagggauuuggcuaccucaauggcgauaacacauggcuggggagaaccauuagcccucggucucgcuccggauucgagaugcuuaaaauccccaaugcgggcacggacccgaacagcagaauuaccgaacggcaggagaucguggacaauaacaacuggucuggguauagcggauccuuuguugauuacuggaaugacaacucugaauguuauaauccuugcuucuacguggagcugaucagaggccgccccgaagaggccaaguaugucugguggacaagcaacuccauuaucgcucucugugggagcccuuuucccgugggcucuggauccuuccccgauggcgcccagauucaguacuuuagcuga

SEQ ID NO: 206659 - RNA, 1416 nt, Artificial Sequence
  derived and/or modified sequence opt5 from neuraminidase__InfluenzaA__AGQ81877
augaaccccaaucagaagcuguucgcccucagcggcguggcuaucgcccuguccguccuuaaccugcucauugggaucucuaauguuggacugaacgugagccuucaccugaaagagaagggcccuaaacaagaagagaauagcacaugcaccacgauuaaccagaauaacaccacaguggucgaaaauaccuacgugaacaauacaaccaucauuacaaaggagaccgaacucaaaacgccgucuuaucugcugcucaacaagagccuguguaauguugagggguggguggucaucgcgaaggacaacgcugugagauuuggagaguccgaacagaucauuguuacccgggagcccuacgugucuugcgauccuacaggcuguaaaauguaugcccuucaucaggggaccacaauccgcaauaagcacagcaacggaaccauucaugacagaacggccuuccggggccugaucuccacaagccucggcacacccccuaccauuucuaacuccgauuuuaugugcgucggguggagcucuaccaccugucacgacggaaucggccgcaugacaauuugcauccaagggaauaacgauaaugcuacggccaccguguacuauaacagacggcugacaaccacaaucaaaaccugggcucgcaauauucuuagaacgcaggaauccgagugugugugccauaacggaaucugugccgucguuaugacagacggcagcgcgucuucccaggccuacaccaaggugauguauuuccacaaagggcugguggucaaggaggaagcucucaagggaagcgcccggcacauugaggaaugcuccuguuacggccauucucagaaagugaccugcguuugccgcgauaauuggcaaggcgcuaacagacccaucauugagaucgacaugaauacacuggaacacaccagccgguacguguguacagggauccugacggauaccucccgcccuggagacaagagcucuggcgauugcuccaacccgauuacagggagccccggagccccuggcgucaaaggguuuggauuccucaauggcgacaacaccuggcugggcagaacaaucucuccccggagccgcuccggguuugagaugcuuaagauuccuaaugcgggaaccgaucccaacucuagaaucgccggccggcaggagauuguggacaauaacaacuggagcggguauuccggauccuucaucgacuacuggaaugauaacucugaauguuauaauccgugcuuuuacguugagcugaucagaggccgcccugaagaggcuaaauaugugugguggacguccaacagccucauugcccugugugggucucccuucccugucggcuccggcagcuuucccgacggagcucagauccaguacuucuccuga

SEQ ID NO: 206660 - RNA, 1416 nt, Artificial Sequence
  derived and/or modified sequence opt5 from neuraminidase__InfluenzaA__AGQ81878
augaaccccaaucagaagcuguucgcccucagcggcguggcuaucgcccuguccguccuuaaccugcucauugggaucucuaauguuggacugaacgugagccuucaccugaaagagaagggcccuaaacaagaagagaaucugaccugcacaacgauuaaccagaauaacaccacaguggucgaaaauaccuacgugaacaauacaaccaucauuacaaaggagaccgaccucaaagcgccguccuaucugcuccugaacaagucucuuuguaauguugaaggguggguggucaucgcuaaggauaacgccgugagauuuggagagagcgagcagaucauuguuacgcgggaacccuacguguccugcgacccuaccggcuguaaaauguaugcccugcaucaggggacaaccauccgcaauaagcacucuaacggaacaauucaugauagaaccgcuuuccggggccucaucagcacgccccugggcacaccucccaccgucuccaacagcgacuuuaugugcgugggguggucuuccacaaccugucacgauggaauuggccgcaugaccaucugcauucaagggaauaacgacaaugccacagcuacgguguacuauaacagacggcuuaccacaaccaucaaaacaugggcccgcaauauccugagaacccaggagagcgaaugugucugccauaacggaacgugugcgguugugaugacagauggcucugccuccagccaggcuuacaccaaggugauguauuuccacaaagggcucgucgugaaggaggaggcccugaagggaucugcucggcacauugaagagugcuccuguuacggccauagccagaaaguuaccugcgugugccgcgacaauuggcaaggcgccaacagaccuaucauugaaaucgauaugaauacacuggagcacaccucccgguacgucuguacagggauucucacggacaccucucgcccgggagauaagagcuccggcgacugcagcaaccccaucacagggucuccuggagcgcccggcgugaaaggguuuggauuccugaauggcgauaacaccuggcuuggcagaacaaucuccccucggagccgcucuggguuugaaaugcugaagauucccaaugccggaaccgacccgaacagcagaaucgcugagcggcaggagauuguugacaauaacaacugguccggcuauucugggagcuucaucgauuacuggaaugacaacuccgaauguuauaauccuugcuuuuacguggagcucauuagaggacgccccgaagaggccaaauaugucugguggacgagcaacucucugaucgcucuuuguggcuccccuuuccccaucgggagcggcucuuuucccgauggagcccagauucaguacuucuccuga

SEQ ID NO: 206661 - RNA, 1416 nt, Artificial Sequence
  derived and/or modified sequence opt5 from neuraminidase__InfluenzaA__AGQ81882
augaaccccaaucagaagcuguucgcccucagcggcguggcuaucgcccuguccguccuuaaccugcucauugggaucucuaauguuggacugaacgugagccuucaccugaaagagaagggcgcgaaacaagaagagaaucuuaccugcacaacgauuaaccagaauaacaccacaguggucgaaaauaccuacgugaacaauacaaccguuaucacaaaggaggcugacuggaaaaccccuuccuaucugcugcucaacaagucucuguguaauguggaagggugggucgugauugccaaggauaacgccaucagauuuggagagagcgagcagaucauuguuacgcgggaaccguacguguccugcgaccccaccggcuguaaaauguaugcucuccaucaggggacaaccauccgcaauaagcacucuaacggaacaauucaugauagaaccgccuuccggggccugaucagcacgccucucggcacacccccuaccgucuccaacagcgacuuuaugugcgugggguggucuuccacaaccugucacgauggaauuggccgcaugaccaucugcauucaagggaauaacgacaaugcuacagccacgguguacuauaacggaagacugaccacaaccaucaaaacaugggcgcggaauauccuucgcacccaggagagcgaaugugucugccauaacggcacgugugccguugugaugacagaugggucugcuuccagccaggccuacaccaaggugauguauuuccacaaaggacuggucauuaaggaggaggcucucaagggcucugccagacacaucgaagagugcuccuguuacggccauagccagaaagugaccugcguuugccgggacaauuggcaaggggcgaaccgccccauuaucgaaauugauaugaauacacuggagcacaccuccagauacguguguacaggaauccugacggacaccucucggccuggcgauaagagcuccggggacugcagcaacccgaucacaggaucucccggcgccccuggggucaaaggauuuggcuuccucaauggcgauaacaccuggcuggggcgcacaauuucccccagaagccggucuggauuugaaaugcuuaagaucccuaaugcuggcauugaccccaacagccgcaucgccgagagacaggagauuguggacaauaacaacugguccggguauucuggcagcuucaucgauuacuggaaugacaacuccgaauguuauaauccgugcuuuuacguugagcugauccggggaagaccugaagaggcuaaauaugugugguggaccagcaacucucucauugcccugugugggucccccuucccugucggcagcggaucuuuucccgauggcgcccagauccaguacuucuccuga

SEQ ID NO: 206662 - RNA, 1416 nt, Artificial Sequence
  derived and/or modified sequence opt5 from neuraminidase__InfluenzaA__AGQ81883
augaaccccaaucagaagcuguucgcccucagcggcguggcuaucgcccuguccguccuuaaccugcucauugggaucucuaauguuggacugaacgugagccuucaccugaaagagaagggcccuaaacaagaagagaaucugaccugcacaacgauuaaccagaauaacaccacaguggucgaaaauaccuacgugaacaauacaaccguuaucacaaaggaggcggacuggaaaaccccguccuaucuccugcucaacaagucucuguguaauguggaagggugggucgugauugcuaaggauaacgccaucagauuuggagagagcgagcagaucauuguuacgcgggaacccuacguguccugcgacccuaccggcuguaaaauguaugcccuucaucaggggacaaccauccgcaauaagcacucuaacggaacaauucaugauagaaccgcuuuccggggccugaucagcacgccccucggcacaccucccaccgucuccaacagcgacuuuaugugcgugggguggucuuccacaaccugucacgauggaauuggccgcaugaccaucugcauucaagggaauaacgacaaugccacagcuacgguguacuauaacggaagacugaccacaaccaucaaaacaugggcccggaauauccuucgcacccaggagagcgaaugugucugccauaacggcacgugugcgguugugaugacagaugggucugccuccagccaggcuuacaccaaggugauguauuuccacaaaggacuggucauuaaggaggaggcccucaagggcucugcuagacacaucgaagagugcuccuguuacggccauagccagaaagugaccugcguuugccgggacaauuggcaaggggccaaccgcccuauuaucgaaauugauaugaauacacuggagcacaccuccagauacguguguacaggaauccugacggacaccucucggccgggcgauaagagcuccggggacugcagcaaccccaucacaggaucuccuggcgcgcccggggucaaaggauuuggcuuccucaauggcgauaacaccuggcuggggcgcacaauuuccccuagaagccggucuggauuugaaaugcuuaagauccccaaugccggcauugacccgaacagccgcaucgcugagagacaggagauuguggacaauaacaacugguccggguauucuggcagcuucaucgauuacuggaaugacaacuccgaauguuauaauccuugcuuuuacguugagcugauccggggaagacccgaagaggccaaauaugugugguggaccagcaacucucucauugcucuguguggguccccuuuccccgucggcagcggaucuuuucccgauggcgcccagauccaguacuucuccuga

SEQ ID NO: 206663 - RNA, 1416 nt, Artificial Sequence; identical to SEQ ID NO: 206662
  derived and/or modified sequence opt5 from neuraminidase__InfluenzaA__AGQ81884

SEQ ID NO: 206664 - RNA, 1416 nt, Artificial Sequence; identical to SEQ ID NO: 206662
  derived and/or modified sequence opt5 from neuraminidase__InfluenzaA__AGQ81885

SEQ ID NO: 206665 - RNA, 1416 nt, Artificial Sequence; identical to SEQ ID NO: 206662
  derived and/or modified sequence opt5 from neuraminidase__InfluenzaA__AGQ81886

SEQ ID NO: 206666 - RNA, 1356 nt, Artificial Sequence
  derived and/or modified sequence opt5 from neuraminidase__InfluenzaA__AGQ81888
augaaccccaaucagaagcuguucgcccucagcggcguggcuaucgcccuguccguccuuaaccugcucauugggcugucuaauguuggacuuaacgugagccugcaccucaaagaggcgggcccuaagcaagaagagaaucugaccugcaugacaacgaaagaaaccgagcuggggacaccguccuaccuccugcuuaacaagucucuguguaauguggaaggaugggucgugaucgcuaaagacaacgccguuagauuuggcgagagcgagcagauuaucauuacccgggaacccuauguguccugcgauccuaauggguguaagauguacgcccuccaucagggaacaaccauccgcaacaagcacucuaauggcacaauccaugacagaaccgcuuuccggggccugauuagcacgccccuugggaccccucccacagucuccaacagcgauuuuaucugcgugggauggucuuccaccacaugucacgacggcauugggcgcaugaccaucugcauucagggaaauaacgauaaugccacggcuacaguuuauuacaacagacggcugaccacaaccaucaaaaccugggcccgcaacauucucagaacacaagagagcgaaugugugugccauaauggcacgugugcggucgugaugaccgacgggucugccuccagccaggcucacacaaaggugauguauuuccacaaaggacuggucguuaaggaggaggcccugaaaggcucugcuaagcauaucgaagagugcuccuguuacggccacaaccagaaggugaccugcgugugccgggauaauuggcagggggccaaccgcccuaucauugaaaucgacaugaauacacucgagcauaccagcagauaugucuguacgggcauucugacagauaccucccggccgggagacaaacccaccggggauugcucuaacccuaucacaggaagccccggcgcgccuggggugaagggauuuggcuuccuuaauggcgacaacaccuggcuggggcgcacaauuucccccagaagccggucuggauuugaaaugcucaaaaucccgaaugccggcaucgauccuaacucccgcauugcugagagacaagagaucguugacaauagcaacuggucuggguacagcggauccuucauugacuacuggaaugauaacucugaauguuauaaucccugcuuuuacguggagcugauccggggcagaccugaagaggccaaguaugucugguggacgagcaacucccuuauugcucugugugggagccccuuccccgugggcucuggauccuuuccugacggcgcccagauccaguacuucagcuga

SEQ ID NO: 206667 - RNA, 1356 nt, Artificial Sequence
  derived and/or modified sequence opt5 from neuraminidase__InfluenzaA__AGQ81889
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccagccaggcccacaccaaggugauguauuuccacaaaggacuggucguuaaggaggaggcucugaaaggcucugccaagcauaucgaagagugcuccuguuacggccacaaccagaaggugacaugcgugugccgggauaauuggcagggggcuaaccgcccuaucauugaaaucgacaugaauacccucgagcauacgagcagauaugucuguacaggcauucugaccgauaccucccggccgggagacaaacccacaggggauugcucuaacccuaucaccggaagccccggcgccccuggggugaagggauuuggcuuccuuaauggcgacaacacauggcuggggcgcacgauuucccccagaagccggucuggauuugaaaugcucaaaaucccgaaugcgggcaucgauccuaacucccgcauugccgagagacaagagaucguugacaauagcaacuggucuggguacagcggauccuucauugacuacuggaaugauaacucugaauguuauaaucccugcuuuuacguggagcugauccggggcagaccugaagaggcuaaguaugucugguggaccagcaacucccuuauugcccugugugggagccccuuccccgugggcucuggauccuuuccugacggcgcucagauccaguacuucagcuga

SEQ ID NO: 206668 - RNA, 1356 nt, Artificial Sequence; identical to SEQ ID NO: 206667
  derived and/or modified sequence opt5 from neuraminidase__InfluenzaA__AGQ81890

SEQ ID NO: 206669 - RNA, 1356 nt, Artificial Sequence; identical to SEQ ID NO: 206667
  derived and/or modified sequence opt5 from neuraminidase__InfluenzaA__AGQ81891

SEQ ID NO: 206670 - RNA, 1356 nt, Artificial Sequence
  derived and/or modified sequence opt5 from neuraminidase__InfluenzaA__AGQ81893
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccagccaggcccacaccaaggugauguauuuccacaaaggacuggucguuaaggaggaggcucugaaaggcucugccaagcauaucgaagagugcuccuguuacggccacaaccagaaggugacaugcgugugccgggauaauuggcagggggcuaaccgcccuaucauugaaaucgacaugaauacccucgagcauacgagcagauaugucuguacaggcauucugaccgauaccucccggccgggagacaaacccacaggggauugcucuaacccuaucaccggaagccccggcgccccuggggugaagggauuuggcuuccuuaauggcgacaacacauggcuggggcgcacgauuucccccagaagccggucuggauuugaaaugcucaaaaucccgaaugcgggcaucgauccuaacucccgcauugccgagagacaagagaucguugacaauagcaacuggucuggguacagcggauccuucauugacuacuggaaugauaacucugaauguuauaaucccugcuuuuacguggagcugauccggggcagaccugaagaggcugaauaugucugguggaccagcaacucccuuauugcccugugugggagccccuuccccgugggcucuggauccuuuccugacggcgcucagauccaguacuucagcuga

SEQ ID NO: 206671 - RNA, 1356 nt, Artificial Sequence; identical to SEQ ID NO: 206667
  derived and/or modified sequence opt5 from neuraminidase__InfluenzaA__AGQ81894

SEQ ID NO: 206672 - RNA, 1356 nt, Artificial Sequence; identical to SEQ ID NO: 206667
  derived and/or modified sequence opt5 from neuraminidase__InfluenzaA__AGQ81895

SEQ ID NO: 206673 - RNA, 1356 nt, Artificial Sequence; identical to SEQ ID NO: 206667
  derived and/or modified sequence opt5 from neuraminidase__InfluenzaA__AGQ81896

SEQ ID NO: 206674 - RNA, 1356 nt, Artificial Sequence; identical to SEQ ID NO: 206667
  derived and/or modified sequence opt5 from neuraminidase__InfluenzaA__AGQ81897

SEQ ID NO: 206675 - RNA, 1356 nt, Artificial Sequence; identical to SEQ ID NO: 206667
  derived and/or modified sequence opt5 from neuraminidase__InfluenzaA__AGQ81898

SEQ ID NO: 206676 - RNA, 1356 nt, Artificial Sequence; identical to SEQ ID NO: 206667
  derived and/or modified sequence opt5 from neuraminidase__InfluenzaA__AGQ81899

SEQ ID NO: 206677 - RNA, 1356 nt, Artificial Sequence; identical to SEQ ID NO: 206667
  derived and/or modified sequence opt5 from neuraminidase__InfluenzaA__AGQ81900

SEQ ID NO: 206678 - RNA, 1356 nt, Artificial Sequence; identical to SEQ ID NO: 206667
  derived and/or modified sequence opt5 from neuraminidase__InfluenzaA__AGQ81901

SEQ ID NO: 206679 - RNA, 1356 nt, Artificial Sequence; identical to SEQ ID NO: 206667
  derived and/or modified sequence opt5 from neuraminidase__InfluenzaA__AGQ81902

SEQ ID NO: 206680 - RNA, 1356 nt, Artificial Sequence; identical to SEQ ID NO: 206667
  derived and/or modified sequence opt5 from neuraminidase__InfluenzaA__AGQ81903

SEQ ID NO: 206681 - RNA, 1356 nt, Artificial Sequence
  derived and/or modified sequence opt5 from neuraminidase__InfluenzaA__AGQ81904
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccagccaggcccacaccaaggugauguauuuccacaaaggacuggucguuaaggaggaggcucugaaaggcucugccaagcauaucgaagagugcuccuguuacggccacaaccagaaggugacaugcgugugccgggauaauuggcagggggcuaaccgcccuaucauugaaaucgacaugaauacccucgagcauacgagcagauaugucuguacaggcauucugaccgauaccucccggccgggagacaaacccacaggggauugcucuaacccuaucaccggaagccccggcgccccuggggugaagggauuuggcuuccuuaauggcgacaacacauggcuggggcgcacgauuucccccagaagccggucuggauuugaaaugcucaaaaucccgaaugcgggcaucgauccuaacucccgcauuaccgagagacaagagaucguugacaauagcaacuggucuggguacagcggauccuucauugacuacuggaaugauaacucugaauguuauaaucccugcuuuuacguggagcugauccggggcagaccugaagaggccaaguaugucugguggacaagcaacucccuuauugcucugugugggagccccuuccccgugggcucuggauccuuuccugacggcgcccagauccaguacuucagcuga

SEQ ID NO: 206682 - RNA, 1356 nt, Artificial Sequence; identical to SEQ ID NO: 206667
  derived and/or modified sequence opt5 from neuraminidase__InfluenzaA__AGQ81905

SEQ ID NO: 206683 - RNA, 1356 nt, Artificial Sequence
  derived and/or modified sequence opt5 from neuraminidase__InfluenzaA__AGQ81906
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccagccaggcccacaccaaggugauguauuuccacaaaggacuggucguuaaggaggaggcucugaaaggcucugcccggcauaucgaagagugcuccuguuacggccacaaccagaaggugacaugcgugugccgcgauaauuggcagggggcuaacagaccuaucauugaaaucgacaugaauacccucgagcauacgagccgguaugucuguacaggcauucugaccgauaccucccgcccgggagacaagcccacaggggauugcucuaacccuaucaccggaagccccggcgccccuggggugaaaggauuuggcuuccuuaauggcgacaacacauggcuggggagaacgauuagcccccggucccgcucuggauuugaaaugcucaagaucccgaaugcgggcaucgauccuaacuccagaauugccgagcggcaagagaucguugacaauagcaacuggucuggguacagcggauccuucauugacuacuggaaugauaacucugaauguuauaaucccugcuuuuacguggagcugaucagaggccgcccugaagaggcuaaauaugucugguggaccagcaacucccuuauugcccugugugggagccccuuccccgugggcucuggauccuuuccugacggcgcucagauccaguacuucagcuga

SEQ ID NO: 206684 - RNA, 1356 nt, Artificial Sequence; identical to SEQ ID NO: 206667
  derived and/or modified sequence opt5 from neuraminidase__InfluenzaA__AGQ81907

SEQ ID NO: 206685 - RNA, 1356 nt, Artificial Sequence
  derived and/or modified sequence opt5 from neuraminidase__InfluenzaA__AGQ81908
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccaaccaggcccacaccaaggugauguauuuccacaaaggacuggucguuaaggaggaggcucugaaaggcagcgccaagcauaucgaagagugcucuuguuacggccacaaucagaaggugacaugcgugugccgggauaacuggcagggggcuaaucgcccuaucauugaaaucgacaugaacacccucgagcauacguccagauaugucuguacaggcauucugaccgauaccagccggccgggagacaaacccacaggggauugcuccaauccuaucaccggaucucccggcgccccuggggugaagggauuuggcuuccuuaacggcgacaauacauggcuggggcgcacgauuagccccagaucccggagcggauuugaaaugcucaaaaucccgaacgcgggcaucgauccuaauucucgcauuaccgagagacaagagaucguugacaacuccaauuggagcggguacucuggcagcuucauugacuacuggaacgauaauuccgaauguuauaaccccugcuuuuacguggagcugauccggggaagaccugaagaggccaaguaugucugguggacaucuaacagccuuauugcucugugugggucccccuuccccgugggcagcggaucuuuuccugacggcgcccagauccaguacuucuccuga

SEQ ID NO: 206686 - RNA, 1356 nt, Artificial Sequence; identical to SEQ ID NO: 206667
  derived and/or modified sequence opt5 from neuraminidase__InfluenzaA__AGQ81909

SEQ ID NO: 206687 - RNA, 1356 nt, Artificial Sequence
  derived and/or modified sequence opt5 from neuraminidase__InfluenzaA__AGQ81910
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccggacaggcccacaccaaggugauguauuuccacaaaggccuggucguuaaggaggaggcucugaaaggcagcgccaagcauaucgaagagugcucuuguuacgggcacaaccagaaggugacaugcgugugccgggauaauuggcagggagcuaaccgcccuaucauugaaaucgacaugaauacccucgagcauacguccagcuaugucuguacaggcauucugaccgauaccuccagaccgggggacaaacccacaggagauugcucuaacccuaucaccggcagccccggggccccuggagugaagggcuuuggcuuccuuaauggggacaacacauggcugggacggacgauuagcccccgcuccagaucuggcuuugaaaugcucaaaaucccgaaugcggggaucgauccuaacucccggauugccgagcgccaagagaucguugacaauagcaacuggucuggauacagcggcuccuucauugacuacuggaaugauaacucugaauguuauaaucccugcuuuuacguggagcugaucagagggcggccugaagaggcuaaguaugucugguggaccagcaacucccuuauugcccuguguggcagccccuuccccgugggaucuggcuccuuuccugacggggcucagauccaguacuucagcuga

SEQ ID NO: 206688 - RNA, 1356 nt, Artificial Sequence
  derived and/or modified sequence opt5 from neuraminidase__InfluenzaA__AGQ81911
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccggacaggcccacaccaaggugauguauuuccacaaaggccuggucguuaaggaggaggcucugaaaggcagcgccaagcauaucgaagagugcucuuguuacgggcacaaccagaaugugacaugcgugugccgggauaacuggcagggagcuaaucgcccuaucauugaaaucgacaugaacacccucgagcauacguccagauaugucuguacaggcauucugaccgauaccagccggccgggggacaagcccacaggagauugcuccaauccuaucaccggcucucccggggccccuggagugaaaggcuuuggcuuccuuaacggggacaauacauggcugggacgcacgauuagccccagaucccggagcggcuuugaaaugcucaagaucccgaacgcggggaucgauccuaauucucgcauugccgagagacaagagaucguugacaacuccaauuggagcggauacucuggcagcuucauugacuacuggaacgauaauuccgaauguuauaaccccugcuuuuacguggagcugauccgggggagaccugaagaggcuaaauaugucugguggaccucuaacagccuuauugcccuguguggcucccccuuccccgugggaagcggcucuuuuccugacggggcucagauccaguacuucuccuga

SEQ ID NO: 206689 - RNA, 1356 nt, Artificial Sequence; identical to SEQ ID NO: 206667
  derived and/or modified sequence opt5 from neuraminidase__InfluenzaA__AGQ81912

SEQ ID NO: 206690 - RNA, 1356 nt, Artificial Sequence
  derived and/or modified sequence opt5 from neuraminidase__InfluenzaA__AGQ81913
augaaccccaaucagaagcuguucgcccucagcggcguggcuaucacccuguccguccuuaaccugcucauugggcugucuaauguuggacuuaacgugagccugcaccucaaagagacaggcccuaagcaagaagagaaucugacgugcaugaccacaaaagaaaccgagcuggggacaccguccuaccuccugcuuaacaagucucuguguaauguggaaggaugggucgugaucgccaaagacaacgcgguuagauuuggcgagagcgagcagauuaucauuacccgggaacccuauguguccugcgauccuaauggguguaagauguacgcucuccaucagggaacaaccauccgcaacaagcacucuaauggcacgauccaugacagaaccgccuuccggggccugauuagcacaccccuugggaccccucccacagucuccaacagcgauuuuaucugcgugggauggucuuccaccacgugucacgacggcauugggcgcaugacaaucugcauucagggaaauaacgauaaugccaccgcuacaguuuauuacaacagacggcugaccaccacaaucaaaacgugggcccgcaacauucucagaacccaagagagcgaaugugugugccauaauggcacaugugcugucgugaugaccgacgggucugccuccggacaggcgcacacaaaggugauguauuuccacaaaggccuggucguuaaggaggaggcccugaaaggcagcgcuaagcauaucgaagagugcucuuguuacgggcacaaccagaaggugaccugcgugugccgggauaauuggcagggagccaaccgcccuaucauugaaaucgacaugaauacgcucgagcauacauccagauaugucuguaccggcauucugaccgauacaagccggccgggggacaaacccaccggagauugcuccaacccuaucacaggcucucccggggcuccuggagugaagggcuuuggcuuccuuaauggggacaacacguggcugggacgcaccauuagccccagaucccggagcggcuuugaaaugcucaaaaucccgaaugccgggaucgauccuaacucucgcauugcggagagacaagagaucguugacaauuccaacuggagcggauacucuggcagcuucauugacuacuggaaugauaacuccgaauguuauaaucccugcuuuuacguggagcugauccgggggagaccugaagaggccaaguaugucugguggacaucuaacagccuuauugcucuguguggcucccccuuccccgugggaagcggcucuuuuccugacggggcccagauccaguacuucuccuga

SEQ ID NO: 206691 - RNA, 1356 nt, Artificial Sequence; identical to SEQ ID NO: 206667
  derived and/or modified sequence opt5 from neuraminidase__InfluenzaA__AGQ81914

SEQ ID NO: 206692 - RNA, 1356 nt, Artificial Sequence; identical to SEQ ID NO: 206667
  derived and/or modified sequence opt5 from neuraminidase__InfluenzaA__AGQ81915

SEQ ID NO: 206693 - RNA, 1416 nt, Artificial Sequence
  derived and/or modified sequence opt5 from neuraminidase__InfluenzaA__AGQ81917
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaucaaccagaauaacaccacaguggucgaaaauaccuacgugaacaauacaaccauuaucacaaaagagaccgaacuggagacgccgaacuaucuccugcuuaauaagucccuguguaacguugagggguggguggucguggcgaaagacaaugcuguuagauuuggagaaucugagcagauuaucgugacccgggaacccuacgucagcugcgauccuaacggcuguaagauguaugcccuccaucaggggacaaccauccgcaacaagcacuccaauggaacaauucaugacagaaccgccuuccggggccugaucucuacgccccuuggcacaccucccaccgugagcaacuccgauuuuauuugcgugggguggagcucuacaaccugucacgacggaaucggccgcaugaccauuugcauccaagggaauaacgauaaugcuacagccacggucuacuauaacagacggcugaccacaaccauuaaaacaugggcucgcaauauccucagaacccaggaguccgaguguguuugccauaacggaacgugugccguggugaugacagacggcagcgcgucuucccaggcccacaccaaggucauguacuuccacaaagggcuggugaucaaggaagaggcucugaaaggaagcgccaagcauauugaagagugcucuuguuauggccacaaucagaagguuaccugcgugugccgggauaacuggcaaggcgcuaaucgcccuaucauugaaaucgacaugaacacacucgagcauaccuccagauacgucuguacagggauucugacggauaccagccggccgggagacaaacccacaggcgauugcuccaauccuaucaccgggucucccggagccccuggcgugaagggguuuggauuccuuaacggcgacaauacauggcugggccgcaccaucagccccagaucccggagcggguuugagaugcucaaaauuccgaacgcgggaaucgauccuaacucucgcauugccgaaagacaggagaucguugacaauuccaacuggagcggcuacucugggagcuucauugacuauuggaaugauaacuccgaauguuacaaucccugcuuuuauguggagcugauccggggaagaccugaagaggcuaaguacgucugguggacgucuaacagccuuaucgcccuguguggcucccccuuccccguggggagcggcucuuuuccugacggagcucagauucaguauuucuccuga

SEQ ID NO: 206694 - RNA, 1356 nt, Artificial Sequence
  derived and/or modified sequence opt5 from neuraminidase__InfluenzaA__AGQ81918
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagggacuguguaauguggaaggcugggucgugaucgcgaaagacaacgcuguuagauuuggggagucugagcagauuaucauuacacgggaacccuaugugagcugcgauccuaauggauguaagauguacgcccuccaucagggcaccacaauccgcaacaagcacuccaauggcaccauccaugacagaacggccuuccgggggcugauuucuacaccccuuggaaccccucccaccgucagcaacuccgauuuuaucugcgugggcuggagcucuacaaccugucacgacgggauuggacgcaugacgaucugcauucagggcaauaacgauaaugcuacagccaccguuuauuacaacagacggcugacaaccaccaucaaaacaugggcucgcaacauucucagaacgcaagaguccgaaugugugugccauaaugggaccugugccgucgugaugacagacggaagcgcgucuucccaggcccacaccaaggugauguauuuccacaaaggccuggucguuaaggaggaggcucugaaaggcagcgccaagcauaucgaagagugcucuuguuacgggcacaaccagaaggugacaugcgugugccgggauaauuggcagggagcuaaccgcccuaucauugaaaucgacaugaauacccucgagcauacguccagauaugucuguacaggcauucugaccgauaccagccggccgggggacaaacccacaggagauugcuccaacccuaucaccggcucucccggggccccuggagugaagggcuuuggcuuccuuaauggggacaacacauggcugggacgcacgauuagccccagaucccggagcggcuuugaaaugcucaaaaucccgaaugcggggaucgauccuaacucucgcauugccgagagacaagagaucguugacaauuccaacuggagcggauacucuggcagcuucauugacuacuggaaugauaacuccgaauguuauaaucccugcuuuuacguggagcugauccgggggagaccugaagaggcuaaguaugucugguggaccucuaacagccuuauugcccuguguggcucccccuuccccgugggaagcggcucuuuuccugacggggcucagauccaguacuucuccuga

SEQ ID NO: 206695 - RNA, 1356 nt, Artificial Sequence; identical to SEQ ID NO: 206667
  derived and/or modified sequence opt5 from neuraminidase__InfluenzaA__AGQ81919

SEQ ID NO: 206696 - RNA, 1356 nt, Artificial Sequence; identical to SEQ ID NO: 206667
  derived and/or modified sequence opt5 from neuraminidase__InfluenzaA__AGQ81920

SEQ ID NO: 206697 - RNA, 1356 nt, Artificial Sequence
  derived and/or modified sequence opt5 from neuraminidase__InfluenzaA__AGQ81921
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcguccggacaggcccacaccaaggugauguauuuccacaaaggccuggucguuaaggaggaggcucugaaaggcagcgccaagcauaucgaagagugcucuuguuacgggcacaaccagaaggugacaugcgugugccgggauaauuggcagggagcuaaccgcccuaucauugaaaucgacaugaauacccucgagcauacguccagauaugucuguacaggcauucugaccgauaccagccggccgggggacaaacccacaggagauugcuccaacccuaucaccggcucucccggggccccuggagugaagggcuuuggcuuccuuaauggggacaacacauggcugggacgcacgauuagccccagaucccggagcggcuuugaaaugcucaaaaucccgaaugcggggaucgauccuaacucucgcauugccgagagacaagagaucguugacaauuccaacuggagcggauacucuggcagcuucauugacuacuggaaugauaacuccgaauguuauaaucccugcuuuuacguggagcugauccgggggagaccugaagaggcuaaguaugucugguggaccucuaacagccuuauugcccuguguggcucccccuuccccgugggaagcggcucuuuuccugacggggcucagauccaguacuucuccuga

SEQ ID NO: 206698 - RNA, 1356 nt, Artificial Sequence; identical to SEQ ID NO: 206667
  derived and/or modified sequence opt5 from neuraminidase__InfluenzaA__AGQ81922

SEQ ID NO: 206699 - RNA, 1356 nt, Artificial Sequence; identical to SEQ ID NO: 206697
  derived and/or modified sequence opt5 from neuraminidase__InfluenzaA__AGQ81923

SEQ ID NO: 206700 - RNA, 1356 nt, Artificial Sequence
  derived and/or modified sequence opt5 from neuraminidase__InfluenzaA__AGQ81924
augaaccccaaucagaagcuguucgcccucagcggcguggcuaucgcccuguccguccuuaaccugcucauugggcugucuaauguuggacuuaacgugagccugcaccucaaagagaccggcccuaagcaagaagagaaucugacaugcaugacgaccaaagaaacagagcuggggaccccguccuaccuccugcuuaacaagucucuguguaauguggaaggaugggucgugaucgcgaaagacaacgcuguuagauuuggcgagagcgagcagauuaucauuacacgggaacccuauguguccugcgauccuaauggguguaagauguacgcccuccaucagggaaccacaauccgcaacaagcacucuaauggcaccauccaugacagaacggccuuccggggccugauuagcacaccccuugggaccccucccaccgucuccaacagcgauuuuaucugcgugggauggucuuccacaaccugucacgacggcauugggcgcaugacgaucugcauucagggaaauaacgauaaugcuacagccaccguuuauuacaacagacggcugacaaccaccaucaaaacaugggcucgcaacauucucagaacgcaagagagcgaaugugugugccauaauggcaccugugccgucgugaugacagacgggucugcgaacucccaggcccacaccaaggugauguauuuccacaaaggacuggucguuaaggaggaggcucugaaaggcagcgccaagcauaucgaagagugcucuuguuacggccacaaucagaaggugacaugcgugugccgggauaacuggcagggggcuaaucgcccuaucauugaaaucgacaugaacacccucgagcauacguccagauaugucuguacaggcauucugaccgauaccagccggccgggagacaaacccacaggggauugcuccaauccuaucaccggaucucccggcgccccuggggugaagggauuuggcuuccuuaacggcgacaauacauggcuggggcgcacgauuagccccagaucccggagcggauuugaaaugcucaaaaucccgaacgcgggcaucgauccuaauucucgcauugccgagagacaagagaucguugacaacuccaauuggagcggguacucuggcagcuucauugacuacuggaacgauaauuccgaauguuauaaccccugcuuuuacguggagcugauccggggaagaccugaagaggcuaaguaugucugguggaccucuaacagccuuauugcccugugugggucccccuuccccgugggcagcggaucuuuuccugacggcgcucagauccaguacuucuccuga

SEQ ID NO: 206701 - RNA, 1356 nt, Artificial Sequence; identical to SEQ ID NO: 206667
  derived and/or modified sequence opt5 from neuraminidase__InfluenzaA__AGQ81925

SEQ ID NO: 206702 - RNA, 1356 nt, Artificial Sequence; identical to SEQ ID NO: 206667
  derived and/or modified sequence opt5 from neuraminidase__InfluenzaA__AGQ81926

SEQ ID NO: 206703 - RNA, 1356 nt, Artificial Sequence; identical to SEQ ID NO: 206667
  derived and/or modified sequence opt5 from neuraminidase__InfluenzaA__AGQ81927

SEQ ID NO: 206704 - RNA, 1356 nt, Artificial Sequence; identical to SEQ ID NO: 206667
  derived and/or modified sequence opt5 from neuraminidase__InfluenzaA__AGQ81928

SEQ ID NO: 206705 - RNA, 1356 nt, Artificial Sequence; identical to SEQ ID NO: 206667
  derived and/or modified sequence opt5 from neuraminidase__InfluenzaA__AGQ81929

SEQ ID NO: 206706 - RNA, 1413 nt, Artificial Sequence
  derived and/or modified sequence opt5 from neuraminidase__InfluenzaA__AGQ81930
augaaccccaaucagaagaucauuaccaucggcagcauuucccuggggcucguggucuucaacguucugcuucacguggugucuaucauugucacagugcugguucucggaagaggcgggaauagcggaaucugcaacgagacggugguccgggaauacaaugagaccgugcgcaucgagaaaauuacacaauggcauaacaccuccguuguggaauaugucccuuacuggucugaaggcaauuauaugaacaauacagaggccaucugugacgugaagggguuugcuccguucagcaaagauaacggaauuagaaucggcucccggggccacguguuugucauucgcgagcccuucguuucuugcagcccuaccgaauguagaacauuuuuccugacccaggggucccuucugaaugacaagcauagcaacggaacggugaaagaucggucucccuuucgcacccucauguccguggaggucggccagagcccuaauguguaccaggccagauucgaagcgguugcuuggucugccacagccugccacgacgggaagaaguggaugaccaucggagugacaggccccgauuccaaagcugucgccgugguucauuaugggggagugccuaccgacgucgugaacagcugggcuggcgauauucugcggacgcaagagucuuccuguacaugcauccagggcaauuguuacugggucaugaccgacgggccggccaaccgccaggcgcaguauagaaucuacaaggccaaccaaggaaaaauugugggccagacagauaucagcuuuaaugggggacacauugaggaaugcuccuguuaccccaacgacggcaagguugagugcgugugucgggauaauuggaccgggaccaaccgcccuguccuggugaucucucccgaccucagcuauagaguuggauaccugugcgcuggccuuccuuccgauacaccccggggcgaagacgcccaguucacggggagcugcaccucuccgaugggaaaucagggcuauggggugaaaggauuuggcuuccgccaagggacagacgucuggaugggcagaaccauuucccggacaagcagaucuggauuugagauccugcgcaucaagaacggcuggacccagacgagcaaggaacaggugcggaaacaagugguugucgauaaucucaacugguccggguacucuggaucuuucacacugccuguggagcuuuccggcaaggacugucuggugcccugcuucugggucgagaugauuagagggaaaccugaagagaagaccaucuggaccagcagcuccagcauugugauguguggaguugauuaugaaguggcugacuggucuuggcacgauggcgccauccuccccuuugacauugauaaaauguga

SEQ ID NO: 206707 - RNA, 1413 nt, Artificial Sequence
  derived and/or modified sequence opt5 from neuraminidase__InfluenzaA__AGQ81931
augaaccccaaucagaagaucauuaccaucggcagccugucccucgggcuggugguccuuaacauucugcuccacaucauuucuaucacaaucacgguucuggugauuccuagaaauggaaacaccggcagcugcaaugagacagugauccgggaauacaacgagaccguccgcauugagaaaaucacacaauggcauaauaccaacauuaucgaauauauugaaaagccggagaaugaccuuuucaugaacaauacagggccccugugugaugccaaaggauuugcuccuuucuccaaggacaacggcaucagaaucgggucuaaaggacacguguuuguuauucgggagcccuucgugagcugcuccccuaccgaaugucgcacguuuuuccucacccagggcucucugcugaaugauaagcauagcaacggcacagucaaggacagaucccccuaccggacccucaugagcguggagaucgggcagucuccuaauguuuaucaggcccgcuuugaagcgguggcuugguccgccacagccugccacgauggcaaaaaguggaugaccauuggagucacggggccggacgcuaaagccguggcugugguccauuacggaggcauccccacagauguuauuaacagcugggccggggacauccugagaacccaagagucuuccuguacaugcauccagggagaguguuauugggugaugaccgauggcccugcgaaccggcaggcccaguaccgcgcuuucaaggccaaacaaggcaagauuaucgggcagaccgaaauuagcuuuaauggaggccacaucgaggaaugcucuuguuaucccaacgaggggaagguggaaugcgucuguagagacaauuggacaggaacgaaccggccugugcuuguuauuuccagcgaucuguccuaccgcgugggcuaccucugcgcugggcugcccucugacaccccgagaggagaggauagccaguucacaggcuccugcaccagcccuaugggcaaucagggguauggagucaaaggcuuuggguuccggcaaggaaacgacguguggaugggccgcacaaucucuagaaccucccggagcggguuugagauccuuaagauuagaaauggcuggauccagaacucuaaagaacagauuaagcgccaaguuguggucgacaauagcaacugguccggauacucuggcagcuucacgcugcccguggagcucacacggagaaauugucuggucccuugcuucuggguggaaaugauccgcgggaaacccgaggaaaagaccauuuggaccuccucuagcuccaucguuauguguggaguggaucacgagauugccaacuggagcuggcaugacggcgcgauccugcccuuugauaucgacaaaauguga

SEQ ID NO: 206708 - RNA, 1413 nt, Artificial Sequence
  derived and/or modified sequence opt5 from neuraminidase__InfluenzaA__AGQ81932
augaaccccaaucagaagaucauuaccaucggcagcauuucccuggggcucguggucuucaacguucugcuucacguggugucuaucauugucacagugcugauccucggaagaggcgggaauaacggaaucugcaaugagacgguugugcgggaauacaacgagaccguccgcauugagaaaaucacacaauggcauaauaccagcgugguugaauaugugccuuacuggaacgaaggcacauauaugaauaacaccgaggccauuugugacgucaagggguuugcuccguucuccaaagauaauggaaucagaauuggcucucggggccacguguuugugauccgcgagcccuucgucagcugcuccccuacagaauguagaaccuuuuuccugacgcaggggucucuucugaacgacaagcauagcaauggaaccguuaaagaucggucccccuuucgcacacucaugagcguggaggugggccagucuccuaacgucuaccaggccagauucgaagcgguggcuugguccgccaccgccugccacgacgggaagaaguggaugacaauuggaguuaccggcagcgauucuaaagcuguggccgucgugcauuaugggggaguucccacggacguggucaauuccugggcuggcgauauccugcggacacaagagagcucuuguaccugcauccagggcaacuguuacugggugaugacagacgggccugccaaccgccaggcgcaguauagaauuuacaaggccaaucaaggaaaagucaucggccagaccgauauuuccuuuaacgggggacacaucgaggaaugcagcuguuacccgaaugacggcaagguggagugcguuugucgggauaacuggaccgggacaaaucgccccgugcuggucauuuccccugaccucucuuauagagugggauaccugugcgcuggccuucccagcgauacgccucggggcgaagacgcccaguucaccggguccugcacaagccccaugggaaaccagggcuaugggguuaaaggauuuggcuuccgccaagggaccgacguguggaugggcagaacaaucucucagaccucccggagcggauuugagauccugagagucaagaauggcuggacgcagacaucuaaggaacaagugcgcaaacaggugguugucgauaaccucaauuggagcggguacuccggaucuuucacccugccgauugagcuuagcggcaaggacugucuggugccuugcuucuggguggagaugauccgggggaaacccgaagagaaguccauuuggaccucuagcuccagcaucgucauguguggaguggauuaugaaguugcugacuggucuuggcacgauggcgccauucucccuuuugacaucgauaaaauguga

SEQ ID NO: 206709 - RNA, 1413 nt, Artificial Sequence
  derived and/or modified sequence opt5 from neuraminidase__InfluenzaA__AGQ81934
augaaccccaaucagaagauccugugcaccagcgccacagcuauugugaucggcacgauugccguccucaucgggauugcgaaccugggacuuaauaucggccugcaccucaaaccuuccuguaacugcucucauagccaaccggagaccacaaauaccucccagacaaucauuaacaauuacuauaacgaaaccaauaucacacagauuucuaacaccaauauccagauggaggaaagagcuagccgggacuucaacaaucugacgaaggggcuuuguaccauuaacuccuggcacaucuacggaaaagauaaugccguucgcauuggcgagaacucugacgugcuggugacaagagaacccuaugucagcugcgauccugacgagugucgguuuuacgcccucucccaagggaccacaauccgcggaaagcauagcaacggcaccauccacgauagaucucaguaucgggcucugauuuccuggccccugagcucuccucccacgguguacaauucccgcguugagugcaucggcuggagcucuacauccugucaugacgggaaaagcagaauguccauuugcaucucuggaccuaacaauaacgccagcgcuguggucugguauaaucggcgcccgguggccgaaauuaacaccugggcgagaaauauccuccggacacaggaguccgaauguguuugccacaacggcgugugucccgucguguucaccgaugggagcgccaccggaccugcugacacacgcaucuacuacuuuaaggagggccggauucugaagugggagucucuuacggggaccgccaaacacaucgaagagugcuccugcuauggagaaagaacaggcauuaccuguacaugccgcgauaauuggcagggcagcaacagacccgugauccggauugacccugucgcuaugacccauacgucucaauacaucuguagccccguucugacagauaauccgagaccuaacgaccccaauguggggaagugcaacgauccuuaucccggaaauaacaacaauggcgugaaaggguucuccuaccucgacggagucaacaccuggcugggccgcaccaucucuacagccagccgguccggguaugagaugcuuaaggugcccaaugcgcugaccgacgauagaagcaaaccuauucagggacagacaaucguucucaacacggacuggucuggcuacuccggcagcuuuauggauuauugggccgaaggggacuguuaccgcgcuugcuucuacguggagcugauucggggaagaccgaaggaggauaaggucugguggaccucuaauuccaucgugagcauguguuccucuacagaauuucugggccagugggacuggcccgauggggccaaaauugaguauuuccucuga

SEQ ID NO: 206710 - RNA, 1413 nt, Artificial Sequence; identical to SEQ ID NO: 206709
  derived and/or modified sequence opt5 from neuraminidase__InfluenzaA__AGQ81935

SEQ ID NO: 206711 - RNA, 1413 nt, Artificial Sequence; identical to SEQ ID NO: 206709
  derived and/or modified sequence opt5 from neuraminidase__InfluenzaA__AGQ81936

SEQ ID NO: 206712 - RNA, 1413 nt, Artificial Sequence; identical to SEQ ID NO: 206709
  derived and/or modified sequence opt5 from neuraminidase__InfluenzaA__AGQ81937

SEQ ID NO: 206713 - RNA, 1413 nt, Artificial Sequence; identical to SEQ ID NO: 206709
  derived and/or modified sequence opt5 from neuraminidase__InfluenzaA__AGQ81938

SEQ ID NO: 206714 - RNA, 1413 nt, Artificial Sequence; identical to SEQ ID NO: 206709
  derived and/or modified sequence opt5 from neuraminidase__InfluenzaA__AGQ81939

SEQ ID NO: 206715 - RNA, 1413 nt, Artificial Sequence
  derived and/or modified sequence opt5 from neuraminidase__InfluenzaA__AGQ81940
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuacccagaucucuaacacaaauauucagauggaggaaagagccagcaagggguucaacaaucugaccaaaggacuuuguacgaucaacuccuggcacauuuacggcaaggacaaugccguccggaucggggagucuagcgauguucuggugacccgcgaacccuauguguccugcgacccugaugaguguagauuuuacgcucucagccaaggaacaaccauccggggcaaacauucuaacggcacaauucacgaccgcucccaguauagagcccugaucagcuggccccugucuuccccucccaccgucuacaacagccggguggagugcauuggguggucuuccacgagcugucaugauggaaagucccgcaugucuaucugcauuagcggcccuaauaacaaugcuuccgccguugugugguauaacagacggccggucgcggaaaucaauacaugggcccgcaacauccucagaacccaggagagcgaaugugugugccacaaugggguuugucccguggucuucacagacggaucugcuaccggcccugccgauacccggauuuacuacuuuaaggaggggaaaauccugaagugggagucccuugcuggaacagccaaacacauugaagagugcagcugcuauggcgaacgcacgggcaucaccuguacaugcagagacaacuggcaggggucuaaucggcccgugauucaaaucgauccuguggcgaugacccauacaagccaguacaucuguucccccguccugaccgacaacccgcgcccuaaugaucccaacauuggaaagugcaaugacccuuaucccggcaacaauaacaacgggguuaaaggauucucuuaccucgauggcgccaauacguggcuggggagaacaaucagcaccgcuucccggagcggauaugagaugcuuaaggugcccaacgcccugaccgacgacagaucuaagccuauucagggccagacaaucgugcucaauaccgauugguccggcuacagcgggucuuuuauggacuauugggcugaaggagauuguuaccgcgccugcuucuacgucgagcugauucggggcagaccgaaagaggacaaggugugguggacauccaacagcaucguuuccauguguucuagcacggaauuucuggggcaauggaauuggcccgauggagccaaaauugaguauuuccucuga

SEQ ID NO: 206716 - RNA, 1413 nt, Artificial Sequence
  derived and/or modified sequence opt5 from neuraminidase__InfluenzaA__AGQ81941
augaaccccaaucagaagauccugugcaccagcgccacagcuauuaucauuggcacgaucgccgugcucauuggggucgcgaaccugggacuuaauaucggccugcaccucaaaccuggguguaacugcucccauucucaaccggaggcuaccaauacaagccagaccaucauuaacaauuacuauaacgaaacaaauaucacccagauuuccaacacaaauauccagauggaggaaagacccaaccggggauucaauaaccugaccaagggccuuuguacgauuaauucuuggcacaucuacgggaaagacaacgccguucgcauuggagagaacagcgaugugcuggugaccagagaaccuuaugucuccugcgaccccgaugagugucgguuuuacgcccucucucaaggcacaaccauccgcggcaagcauagcaaugggacaauccacgacagaucccaguaucgggcucugauuagcuggccucugucuuccccucccaccguguacaacagccgcguugagugcaucggauggucuuccacgagcugucaugauggcaaaucuagaauguccauuugcaucagcgggccgaauaacaaugccuccgcuguggucugguauaaccggcgccccguggccgaaauuaauacaugggcgagaaacauccuccggacccaggagucugaauguguuugccacaauggaguguguccugucguguucacagacggcagcgccaccgggcccgcugauacccgcguguacuacuuuagagagggaaagauccugaagugggagucccuuacaggcacggcccggcacauugaagagugcagcugcuauggcgaacgcaccgggaucacauguaccugcagagacaacuggcagggaucuaaucggccugucauucaaaucgaucccguugcuaugacacauaccucccaguacauuuguagcccggugcugacggacaacccuagacccaaugauccuaacgugggcaaaugcaaugaccccuaucccgggaacaacaauaacggagucaagggcuucucuuaccucgauggggugaauacauggcugggacgcaccaucagcaccgccucccggucuggcuaugagaugcuuaaaguuccuaacgcgcugacagacgacagaagcaagccgauccagggccagaccauugugcucaauacagauugguccggguacagcggaucuuuuauggacuauugggccgaaggcgauuguuaccgcgcuugcuucuacgucgagcugauccgggggagacccaaagaggacaaggugugguggacguccaacagcauuguuucuauguguuccagcaccgaauuucugggacaaugggauuggccugacggcgccaagaucgaguauuuccucuga

SEQ ID NO: 206717 - RNA, 1413 nt, Artificial Sequence
  derived and/or modified sequence opt5 from neuraminidase__InfluenzaA__AGQ81942
augaaccccaaucagaagauccugugcaccagcgccacagcuauuaucauuggcacgaucgccgugcucauuggggucgcgaaccugggacuuaauaucggccugcaccucaaaccuggguguaacugcucccauucucaaccggaggcuaccaauacaagccagaccaucauuaacaauuacuauaacgaaacaaauaucacccagauuuccaacacaaauauccagauggaggaaagacccucucggggauucaacaaucugaccaagggccuuuguacgauuaacagcuggcacaucuacgggaaagacaaugccguucgcauuggagagaacuccgaugugcuggugaccagagaaccuuaugucucuugcgaccccgaugagugucgguuuuacgcccucagccaaggcacaaccauccgcggcaagcauuccaacgggacaauccacgacagaagccaguaucgggcucugauuucuuggccucuguccucucccccuaccguguacaauagccgcguugagugcaucggaugguccagcacgucuugucaugauggcaaauccagaaugagcauuugcaucuccgggccgaacaauaacgccucugcuauugugugguauaaucggcgccccgucgccgaaaucaacacaugggcgagaaauauccuccggacccaggagagcgaaugugugugccacaacggaguuuguccuguggucuucacagacggcuccgccaccgggcccgcugauacccgcguguacuacuuuagagagggaaagauucugaagugggagagccuuacaggcacggcccggcacaucgaagagugcucuugcuauggcgaacgcaccgggauuacauguaccugcagagacaauuggcagggauccaaccggccugugauccaaauugaucccgucgcuaugacacauaccagccaguacaucuguucuccgguucugacggacaauccuagacccaacgauccuaaugugggcaaaugcaacgaccccuaucccgggaauaacaacaauggagugaagggcuucagcuaccucgauggggucaacacauggcugggacgcaccaucuccaccgccucucggagcggcuaugagaugcuuaaagugccuaaugcgcugacagacgacagauccaagccgauucagggccagaccaucauucucaacacagauuggagcggguacucuggauccuuuauggacuauugggccgaaggcgauuguuaccgcgcuugcuucuacguugagcugauccgggggagacccaaagaggacaaggugugguggacgagcaauucuauugucuccauguguagcuccaccgaauuucugggacaaugggauuggccugacggcgccaagaucgaguauuuccucuga

SEQ ID NO: 206718 - RNA, 1413 nt, Artificial Sequence
  derived and/or modified sequence opt5 from neuraminidase__InfluenzaA__AGQ81943
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuacccagaucucuaacacaaauauucagauggaggaaagaaccagccggggguucaacaaucugacgaagggacuuuguaccaucaacuccuggcacauuuacggcaaagacaaugccauccgcaucggggagucuagcgauguccugguuacaagagaacccuauguguccugcgacccugaugagugucgguuuuacgcccucagccaaggaaccacaauucgcggcaagcauucuaacggcaccauccacgacagaucccaguaucgggcucugauuagcuggccccugucuuccccucccacgguguacaacagccgcgucgagugcaucggguggucuuccacaagcugucaugauggaaaauccagaaugucuauuugcaucagcggcccuaauaacaaugccuccgcugugguuugguauaaccggcgcccgguggccgaaaucaauaccugggcgagaaacauucuccggacacaggagagcgaaugugucugccacaauggggugugucccguuguguucaccgacggaucugccaccggcccugcugauacacgcaucuacuacuuuaaggaggggcggauucugaagugggagucccuuacgggaaccgccaaacacaucgaagagugcagcugcuauggcgaaagaacaggcauuaccuguacaugccgcgacaacuggcaggggucuaauagacccgucauccaaaucgauccuguggcuaugacccauacgagccaguacauuuguucccccgugcugacagacaacccgcggccuaaugaucccaacaucggaaagugcaaugacccuuaucccggcaacaauaacaacggggucaaaggauucucuuaccucgauggcgccaauaccuggcuggggagaaccauuagcacagcgucccgcagcggauaugagaugcuuaagguucccaacgcccugaccgacgaccggucuaaaccuauccagggccagacaauugugcucaauacggauugguccggcuacagcgggucuuuuauggacuauugggcugaaggagauuguuacagagccugcuucuacguggagcugauccgcggccggccgaaggaggacaaggucugguggaccuccaacagcauuguguccauguguucuagcacagaauuucuggggcaauggaauuggcccgauggagcuaaaaucgaguauuuccucuga

SEQ ID NO: 206719 - RNA, 1413 nt, Artificial Sequence; identical to SEQ ID NO: 206709
  derived and/or modified sequence opt5 from neuraminidase__InfluenzaA__AGQ81944

SEQ ID NO: 206720 - RNA, 1413 nt, Artificial Sequence
  derived and/or modified sequence opt5 from neuraminidase__InfluenzaA__AGQ81947
augaaccccaaucagaagauccugugcaccagcgccacagcucucgugauuggcacgaucgccguccugauugggaucgcgaaccuuggacugaauauuggccuccaccugaaaccuuccuguaacugcucucauagccaaccggaggcuaccaauacaucccagaccaucaucaacaauuacuauaacgaaacaaauauuacccagaucucuaacacaaauauucagauggaggaaagagccagccgguccuucaacaaucuuaccaaggggcuguguacgaucaacucuuggcacauuuacggaaaagacaaugccauccgcauuggcgagaacagcgauguucucgugaccagagaacccuauguguccugcgacccugaugagugucgguuuuacgcucugagccaagggacaaccauccgcggaaagcauucuaacggcacaauccacgacagaucccaguaucgggcccugauuagcuggccccucucuuccccucccaccgucuacaauagccgcguggagugcaucggcuggucuuccacgagcugucaugaugggaaauccagaaugucuauuugcaucagcggaccuaacaauaacgcuuccgccguugugugguauaaucggcgcccggucgcggaaauuaacacaugggccagaaauauccugcggacccaggagagcgaaugugugugccacaacggcguuugucccguggucuucacagacgggucugcuaccggaccugccgauacccgcaucuacuacuuuaaggagggcaagauucuuaaaugggagucccugacagggacggcuaagcacaucgaagagugcagcugcuauggagaaagaaccggcauuacauguaccugccgggacaauuggcagggcucuaaccgccccgugauccaaauugauccuguggccaugacacauaccagccaguacaucuguucccccguccucacggacaauccgagaccuaacgaucccaauguugggaaaugcaacgacccuuaucccggaaauaacaacaauggcgugaagggguucucuuaccuggauggagugaacacauggcuuggccggaccaucagcaccgcguccagaagcggguaugagaugcugaaaguccccaaugcccucacagacgaccgcucuaagccuauucagggacagaccaucgugcugaacacagauugguccggcuacagcggcucuuuuauggacuauugggcugaaggggauuguuaccgggccugcuucuacguugagcugauuagaggacgcccgaaggaggacaaagugugguggacguccaauagcaucgucuccauguguucuagcaccgaauuucucggccaauggaacuggcccgauggggcuaagauugaguauuuccuguga

SEQ ID NO: 206721 - RNA, 1413 nt, Artificial Sequence
  derived and/or modified sequence opt5 from neuraminidase__InfluenzaA__AGQ81948
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuacccagaucucuaacacaaauauucagauggaggaaagaaccagccggggguucaacaaucugacgaagggacuuuguaccaucaacuccuggcacauuuacggcaaagacaaugccauccgcaucggggagucuagcgauguccugguuacaagagaacccuauguguccugcgacccugaugagugucgguuuuacgcccucagccaaggaaccacaauucgcggcaagcauucuaacggcaccauccacgacagaucccaguaucgggcucugauuagcuggccccugucuuccccucccacgguguacaacagccgcgucgagugcaucggguggucuuccacaagcugucaugauggaaaauccagaaugucuauuugcaucagcggcccuaauaacaaugccuccgcugugguuugguauaaccggcgcccgguggccgaaaucaauaccugggcgagaaacauucuccggacacaggagagcgaaugugucugccacaauggggugugucccguuguguucaccgacggaucugccaccggcccugcugauacacgcaucuacuacuuuaaggaggggcggauucugaagugggagucccuuacgggaaccgccaaacacaucgaagagugcagcugcuauggcgaaagaacaggcauuaccuguacaugccgcgacaacuggcaggggucuaauagacccgucauccaaaucgauccuguggcuaugacccauacgagccaguacauuuguucccccgugcugacagacaacccgcggccuaaugaucccaacaucggaaagugcaaugacccuuaucccggcaacaauaacaacggggucaaaggauucucuuaccucgauggcgccaauaccuggcuggggagaaccauuagcacagcgucccgcagcggauaugagaugcuuaagguucccaacgcccugaccgacgaccggucuaaaccuauccagggccagacaauugugcucaauacggauugguccggcuacagcgggucuuuuauggacuauugggcugaaggagaguguuacagagccugcuucuacguggagcugauccgcggccggccgaaggaagauaaggucugguggaccuccaacagcauuguguccauguguucuagcacagaguuucuggggcaauggaauuggcccgacggagcuaaaaucgaauauuuccucuga

SEQ ID NO: 206722 - RNA, 1413 nt, Artificial Sequence
  derived and/or modified sequence opt5 from neuraminidase__InfluenzaA__AGQ81951
augaaccccaaucagaagauccugugcaccagcgccacagcuauugugaucggcacgauugccguccucaucgggguugcgaaccugggacuuaauauuggccugcaccucaaaccuggguguaacugcucccaaucucagccggaggcuaccaauacaagccagaccaucaucaacaauuacuauaacgaaacaaauauuacccagaucuccaacacaaauauucaaauggaggaaagagccaaccggggauucaauaaccugaccaagggccuuuguacgaucaauucuuggcauauuuacgggaaagacaacgccgugcgcaucggagagaacagcgaugugcuggucaccagagaacccuauguguccugcgacccugaugagugucgguuuuacgcucucucucagggcacaaccauucgcggcaagcacagcaaugggacaauccaugacagaucccaguaucgggcccugaucagcuggccccugucuuccccucccaccguuuacaacagccgcguggagugcauuggauggucuuccacgagcugucacgauggcaaaucuagaauguccaucugcauuagcgggccuaauaacaaugcuuccgccgucgugugguauaaccggcgcccgguugcggaaaucaauacaugggccagaaacauucuccggacccaggagucugaaugugugugccauaauggagucugucccgugguguucacagacggcagcgcuaccgggccugccgauacccgcgucuacuacuuuagagagggaaagauccugaagugggagucccuuacaggcacggcuaaacacaucgaagagugcagcugcuauggcgaacggaccgggauuacauguaccugccgcgacaacuggcaaggaucuaauagacccguuauccagauugauccuguggccaugacacacaccucccaguacaucuguagccccgugcugacggacaacccgcggccuaaugaucccaacgucggcaagugcaaugacccuuaucccgggaacaacaauaacggagugaaaggcuucucuuaccucgaugggguuaauacauggcugggaagaaccauuagcaccgcgucccgcucuggcuaugagaugcuuaaggugcccaacgcccugacagacgaccggagcaaaccuauccagggccaaaccaucguccucaauacagauugguccggguacagcggaucuuuuauggacuauugggcugaaggcgauuguuacagagccugcuucuacguggagcugauucgcgggcggccgaaggaggacaagguuugguggacguccaacagcaucgugucuauguguuccagcaccgaauuucugggacaguggaauuggcccgauggcgcuaaaauugaguauuuccucuga

SEQ ID NO: 206723 - RNA, 1413 nt, Artificial Sequence
  derived and/or modified sequence opt5 from neuraminidase__InfluenzaA__AGQ81952
augaaccccaaucagaagauccugugcaccagcgccacagcuauugugaucggcacgauugccguccucaucgggguugcgaaccugggacuuaauauuggccugcaccucaaaccuggguguaacugcucccauucucaaccggaggcuaccaauacaagccagaccaucaucaacaauuacuauaacgaaacaaauauuacccagaucuccaacacaaauauucagauggaggaaagagccaaccggggauucaauaaccugaccaagggccuuuguacgaucaauucuuggcacauuuacgggaaagacaacgccgugcgcaucggagagaacagcgaugugcuggucaccagagaacccuauguguccugcgacccugaugagugucgguuuuacgcucucucucaaggcacaaccauucgcggcaagcauagcaaugggacaauccacgacagaucccaguaucgggcccugaucagcuggccccugucuuccccucccaccguuuacaacagccgcguggagugcauuggauggucuuccacgagcugucaugauggcaaaucuagaauguccaucugcauuagcgggccuaauaacaaugcuuccgccgucgugugguauaaccggcgcccgguugcggaaaucaauacaugggccagaaacauucuccggacccaggagucugaaugugugugccacaauggagucugucccgugguguucacagacggcagcgcuaccgggccugccgauacccgcgucuacuacuuuagagagggaaagauccugaagugggagucccuuacaggcacggcuaaacacaucgaagagugcagcugcuauggcgaacggaccgggauuacauguaccugccgcgacaacuggcagggaucuaauagacccguuauccaaauugauccuguggccaugacacauaccucccaguacaucuguagccccgugcugacggacaacccgcggccuaaugaucccaacgucggcaagugcaaugacccuuaucccgggaacaacaauaacggagugaaaggcuucucuuaccucgaugggguuaauacauggcugggaagaaccauuagcaccgcgucccgcucuggcuaugagaugcuuaaggugcccaacgcccugacagacgaccggagcaaaccuauccagggccagaccaucguccucaauacagauugguccggguacagcggaucuuuuauggacuauugggcugaaggcgauuguuacagagccugcuucuacguggagcugauucgcgggcggccgaaggaggacaagguuugguggacguccaacagcaucgugucuauguguuccagcaccgaauuucugggacaauggaauuggcccgauggcgcuaaaauugaguauuuccucuga

SEQ ID NO: 206724 - RNA, 1413 nt, Artificial Sequence
  derived and/or modified sequence opt5 from neuraminidase__InfluenzaA__AGQ81954
augaaccccaaucagaagauccugugcaccagcgccacagcuauugugaucggcacgauugccguccucaucgggguugcgaaccugggacuuaauauuggccugcaccucaaaccuuccuguaacugcucucauagccaaccggaggcuaccaauacaucccagaccaucaucaacaauuacuauaacgaaacaaauauuacccagaucucuaacacaaauauucagauggaggaaagagccagccggggguucaacaaucugaccaagggacuuuguacgaucaacuccuggcacauuuacggcaaagacaaugccgugcgcaucggggagaacucugaugugcuggucaccagagaacccuaugugagcugcgacccugaugagugucgguuuuacgcucucucccaaggaacaaccauucgcggcaagcauagcaacggcacaauccacgacagaucucaguaucgggcccugaucuccuggccccugagcucuccucccaccguuuacaauucccgcguggagugcauuggguggagcucuacguccugucaugauggaaaaagcagaauguccaucugcauuucuggcccuaacaauaacgcuagcgccgucgugugguauaaucggcgcccgguugcggaaaucaacacaugggccagaaauauucuccggacccaggaguccgaaugugugugccacaacggggucugucccgugguguucacagacggaagcgcuaccggcccugccgauacccgcgucuacuacuuuaaggaggggaagauccugaaaugggagucucuuacaggaacggcuaagcacaucgaagagugcuccugcuauggcgaaagaaccggcauuacauguaccugccgggacaauuggcaggggagcaaccgccccguuauccaaauugauccuguggccaugacacauaccucucaguacaucuguagccccgugcugacggacaauccgagaccuaacgaucccaaugucggaaaaugcaacgacccuuaucccggcaauaacaacaauggggugaagggauucuccuaccucgauggcguuaacacauggcuggggcggaccauuucuaccgcgagcagauccggauaugagaugcuuaaagugcccaaugcccugacagacgaccgcagcaagccuauccagggccagaccaucguccucaacacagauuggucuggcuacuccgggagcuuuauggacuauugggcugaaggagauuguuaccgggccugcuucuacguggagcugauuagaggccgcccgaaggaggacaaaguuugguggacgucuaauuccaucgugagcauguguuccucuaccgaauuucuggggcaauggaacuggcccgauggagcuaagauugaguauuuccucuga

SEQ ID NO: 206725 - RNA, 1413 nt, Artificial Sequence
  derived and/or modified sequence opt5 from neuraminidase__InfluenzaA__AGQ81956
augaaccccaaucagaagauccugugcaccagcgccacagcuauugugaucggcacgauugccguccucaucgggguugcgaaccugggacuuaauauuggccugcaccucaaaccuuccuguaacugcucucauagccaaccggaggcuaccaauacaucccagaccaucaucaacaauuacuauaacgaaacaaauauuacccagaucucuaacacaaauauucagauggaggaaagagccagccggggguucaacaaucugaccaagggacuuuguacgaucaacuccuggcacauuuacggcaaagacaaugccgugcgcaucggggagaacucugaugugcuggucaccagagaacccuaugugagcugcgacccugaugagugucgguuuuacgcucucucccaaggaacaaccauucgcggcaagcauagcaacggcacaauccacgacagaucucaguaucgggcccugaucuccuggccccugagcucuccucccaccguuuacaauucccgcguggagugcauuggguggagcucuacguccugucaugauggaaaaagcagaauguccaucugcauuucuggcccuaacaauaacgcuagcgccaucgucugguauaaucggcgcccgguggcggaaauuaacacaugggccagaaauauccuccggacccaggaguccgaauguguuugccacaacggggugugucccgucguguucacagacggaagcgcuaccggcccugccgauacccgcguguacuacuuuaaggaggggaagauccugaaaugggagucucuuacaggaacggcuaagcacauugaagagugcuccugcuauggcgaaagaaccggcaucacauguaccugccgggacaauuggcaggggagcaaccgccccgucauucaaaucgauccuguugccaugacacauaccucucaguacauuuguagccccgugcugacggacaauccgagaccuaacgaucccaaugugggaaaaugcaacgacccuuaucccggcaauaacaacaauggggucaagggauucuccuaccucgauggcgugaacacauggcuggggcggaccaucucuaccgcgagcagauccggauaugagaugcuuaaaguucccaaugcccugacagacgaccgcagcaagccuauccagggccagaccauugugcucaacacagauuggucuggcuacuccgggagcuuuauggacuauugggcugaaggagauuguuaccgggccugcuucuacgucgagcugaucagaggccgcccgaaggaggacaaagugugguggacgucuaauuccauuguuagcauguguuccucuaccgaauuucuggggcaauggaacuggcccgauggagcuaagaucgaguauuuccucuga

SEQ ID NO: 206726 - RNA, 1413 nt, Artificial Sequence
  derived and/or modified sequence opt5 from neuraminidase__InfluenzaA__AGQ81957
augaaccccaaucagaagauccugugcaccagcgccacagcuauugugaucggcacgauugccguccucaucgggauugcgaaccugggacuuaauaucggccugcaccucaaaccuuccuguaacugcucucauagccaaccggaggcuaccaauacaucccagaucauuaucaacaauuacuauaacgaaaccaauauuacacagguuucuaacaccaauauccagauggaggaaagagccagccggggguucaacaaucugacaaagggacuuuguaccauuaacuccuggcacaucuacggcaaagacaaugccgugcgcauuggggagaacucugaugugcuggucacgagagaacccuaugugagcugcgacccugaugagugucgguuuuacgcucucucccaaggaaccacaauccgcggcaagcauagcaacggcaccauccacgacagaucucaguaucgggcccugauuuccuggccccugagcucuccucccacaguuuacaauucccgcguggagugcaucggguggagcucuaccuccugucaugauggaaaaagcagaauguccauuugcaucucuggcccuaacaauaacgcuagcgccgucgugugguauaaucggcgcccgguugcggaaauuaacacgugggccagaaauauccuccggacacaggaguccgaaugugugugccacaacggggucugucccgugguguucaccgacggaagcgcuacaggcccugccgauacccgcaucuacuacuuuaaggaggggaagauucugaaaugggagucucuuaccggaacagcuaagcacaucgaagagugcuccugcuauggcgaaagaacgggcauuaccuguacaugccgggacaauuggcaggggagcaaccgccccgucauccaaauugauccuguugccaugacccauacaucucaguacaucuguagccccgugcugaccgacaauccgagaccuaacgaucccaaugugggaaaaugcaacgacccuuaucccggcaauaacaacaauggggucaagggauucuccuaccucgauggcgugaacacguggcuggggcggacaaucucuaccgcgagcagauccggauaugagaugcuuaaaguucccaaugcccugaccgacgaccgcagcaagccugugcagggccagacaauuguccucaacaccgauuggucuggcuacuccgggagcuuuauggacuauugggcugaaggagauuguuaccgggccugcuucuacguggagcugaucagaggccgcccgaaggaggacaaaguuugguggacaucuaauuccauugugagcauguguuccucuacggaauuucuggggcaauggaacuggcccgauggagcuaagaucgaguauuuccucuga

SEQ ID NO: 206727 - RNA, 1413 nt, Artificial Sequence; identical to SEQ ID NO: 206709
  derived and/or modified sequence opt5 from neuraminidase__InfluenzaA__AGQ81958

SEQ ID NO: 206728 - RNA, 1413 nt, Artificial Sequence; identical to SEQ ID NO: 206709
  derived and/or modified sequence opt5 from neuraminidase__InfluenzaA__AGQ81959

SEQ ID NO: 206729 - RNA, 1413 nt, Artificial Sequence
  derived and/or modified sequence opt5 from neuraminidase__InfluenzaA__AGQ81960
augaaccccaaucagaagauccugugcaccagcgccacagcuauugugaucggcacgauugccguccucaucgggauugcgaaccugggacuuaauaucggccugcaccucaaaccuaacuguaauugcuccagaucucaaccggagaccacaaacaccagccagacaaucauuaauaacuacuauaaugaaaccaacaucacacagauuuccaauaccaacauccagauggaggaacgggcuucucgcgacuucaauaaccugacgaaggggcuuuguaccauuaauagcuggcauaucuacggaaaagauaacgccguuagaauuggcgagaacuccgacgugcuggugacacgggaacccuaugucucuugcgauccuaaugagugucgcuuuuacgcccucagccaagggaccacaaucagaggaaagcacuccaacggcaccauccaugaccggagccaguaucgcgcucugauuucuuggccccuguccagcccucccacgguguacaauucuagaguugagugcaucggcugguccagcacaucuugucacgaugggaaaucccggaugagcauuugcaucuccggaccuaacaauaacgccucugcuguggucugguauaaucgcagaccgguggccgaaauuaacaccugggcgcggaauauccuccgcacacaggagagcgaauguguuugccauaacggcgugugucccgucguguucaccgacggguccgccaccggaccugcugauacaagaaucuacuacuuuaaggagggcaagauucugaaaugggagagccuuacggggaccgccaagcacaucgaagagugcucuugcuauggagaacggacagagauuaccuguacaugccgcgacaauuggcagggcuccaacagacccgugauccaaauugauccugucgcuaugacccacacgagccaguacaucuguucucccguucugacagacaauccgcggccuaacgaucccaaugugggcaaaugcaacgacccuuaucccgggaacaauaacaauggagugaagggcuucagcuaccucgauggggucaacaccuggcugggaagaaccaucuccacagccucucgcagcggcuaugaaaugcuuaaagugcccaaugcgcugaccgacgaccgguccaagccuauucaggggcagacaaucguucucaacacggauuggagcggauacucuggcuccuuuauggacuauugggccgagggcgauuguuacagagcuugcuucuacguggagcugauucgcgggcggccgaaggaagacaaagucugguggaccagcaauucuaucguguccauguguagcuccacagaguuucugggacaaugggauuggcccgacggcgccaagauugaauauuuccucuga

SEQ ID NO: 206730 - RNA, 1413 nt, Artificial Sequence; identical to SEQ ID NO: 206722
  derived and/or modified sequence opt5 from neuraminidase__InfluenzaA__AGQ81961

SEQ ID NO: 206731 - RNA, 1413 nt, Artificial Sequence; identical to SEQ ID NO: 206722
  derived and/or modified sequence opt5 from neuraminidase__InfluenzaA__AGQ81962

SEQ ID NO: 206732 - RNA, 1413 nt, Artificial Sequence
  derived and/or modified sequence opt5 from neuraminidase__InfluenzaA__AGQ81963
augaaccccaaucagaagauccugugcaccagcgccacagcuauugugaucggcacgauugccguccucaucgggauugcgaaccugggacuuaauaucggccugcaccucaaaccuuccuguaacugcucucauagccaaccggaggaaaccaauacaucccagaccaucauuaacaauuacuauaacgagacaaauaucacccagauuucuaacacaaauauccagauggaagagagagcuagccggggguucaacaaucugaccaagggacuuuguacgauuaacuccuggcacaucuacggcaaagacaaugccguucgcauuggggaaaacucugaugugcuggugaccagagagcccuaugucagcugcgacccuaacgagugucgguuuuacgcccucucccaaggaacaaccauccgcggcaagcauagcaauggcacaauccacgauagaucucaguaucgggcucugauuuccuggccccugagcucuccucccaccguguacaacucccgcguugaaugcaucggguggagcucuacguccugucaugacggaaaaagcagaauguccgugugcauuucuggcccuaaugauaacgccagcgcugucgugugguauaaucggcgcccgguugccgagaucaacacaugggcgagaaauauucuccggacccaggaauccgagugugugugccacaacggggucugucccgugguguucacagacggaagcgccaccggcccugcucacacccgcaucuacuacuuuaaggaggggaagauccugaaaugggaaucucuuacaggaacggccaagcauauugaggaaugcuccugcuauggcgagagaaccggcaucacauguaccugccgggauaauuggcaggggagcaaccgccccgucauucaaaucgacccuguugcuaugacacacaccucucaguacauuuguagccccgugcugacggauaauccgagaccuaacgaccccaaugugggaaaaugcaacgauccuuaucccggcaauaacaacaauggggucaagggauucuccuaccucgacggcgugaacacauggcuggggcggaccaucucuaccgccagcagauccggauaugaaaugcuuaaaguucccaaugcgcugacagaugaccgcagcaagccuauccagggccagaccauugugcucaacacagacuggucuggcuacuccgggagcuuuauggauuauuggacggagggagacuguuaccgggccugcuucuacgucgagcugaucagaggccgcccgaaggaagauaaagugugguggaccucuaauuccauuguuagcauguguuccucuacagaguuucuggggcaaugggacuggcccgauggagcuaagaucgaauauuuccucuga

SEQ ID NO: 206733 - RNA, 1413 nt, Artificial Sequence
  derived and/or modified sequence opt5 from neuraminidase__InfluenzaA__AGQ81964
augaaccccaaucagaagauccugugcaccagcgccacagcuauugugaucggcacgauugccguccucaucgggauugcgaaccugggacuuaauaucggccugcaccucaaaccuuccuguaacugcucucauagcaagccggaggaaaccaaugcuucccaaacaaucauuaacaauuacuauaacgagaccaauaucacacagauuucuaacaccaauauccagauggaagagagagccagccggggguucaacaaucugacaaaaggacuuuguaccauuaacuccuggcacaucuacggcaaggacaaugccguucgcauuggggaaucuagcgaugugcuggugacgagagagcccuaugucuccugcgacccugaugagugucgguuuuacgcucucagccagggaaccacaauccgcggcaaacauucuaacggcaccauccacgacagaucccaauaucgggcccugauuagcuggccccugucuuccccucccacaguguacaacagccgcguugaaugcaucggguggucuuccaccagcugucaugauggaaaguccagaaugucuauuugcaucagcggcccuaauaacaaugcuuccgccguggucugguauaaccggcgcccgguggcggagauuaauacgugggccagaaacauccuccggacacaggaaagcgaguguguuugccacaauggggugugucccgucguguucaccgacggaucugcuacaggcccugccgauacccgcaucuacuacuuuaaggaggggaaaauucugaagugggaaucccuuaccggaacagcuaaacacaucgaggaaugcagcugcuauggcgagagaacgggcauuaccuguacaugccgggacaacuggcaggggucuaaucgccccgugauccagauugauccugucgccaugacccauacaagccaauacaucuguucccccguucugaccgacaacccgagaccuaaugaucccaacgugggaaagugcaaugacccuuaucccggcaacaauaacaacggggugaaaggauucucuuaccucgauggcgucaauacguggcuggggcggacaaccagcaccacauccagaagcggauaugaaaugcuuaaggugcccaacgcgcugaccgacgaccgcucuaagccuauccagggccagacaauuguucucaauacggauugguccggcuacagcgggucuuuuauggacuauugggccgagggagauuguuaccgggcuugcuucuacguggagcugaucagaggccgcccgaaagaagacaaggucugguggaccuccaacagcauuguguccauguguucuagcacagaguuucuggggcaguggaauuggcccgauggagccaaaaucgaauauuuccucuga

SEQ ID NO: 206734 - RNA, 1413 nt, Artificial Sequence
  derived and/or modified sequence opt5 from neuraminidase__InfluenzaA__AGQ81966
augaaccccaaucagagaauccugugcaccagcgccacagcuauugugaucggcacgauugccguccucaucgggguugcgaaccugggacuuaauauuggccugcaccucaagccuggguguaacugcucccauucucaaccggaggcuaccaauacaagccagaccaucaucaacaauuacuauaacgaaacaaauauuacccagaucuccaacacaaauauucagauggaggaacgggccaaccgcggauucaauaaccugaccaaaggccuuuguacgaucaauucuuggcacauuuacgggaaggacaacgccgugagaaucggagagaacagcgaugugcuggucacccgggaacccuauguguccugcgacccugaugagugucgcuuuuacgcucucucucaaggcacaaccauuagaggcaaacauagcaaugggacaauccacgaccggucccaguaucgcgcccugaucagcuggccccugucuuccccucccaccguuuacaacagcagaguggagugcauuggauggucuuccacgagcugucaugauggcaagucucggauguccaucugcauuagcgggccuaauaacaaugcuuccgccgucgugugguauaaccgcagaccgguugcggaaaucaauacaugggcccggaacauucuccgcacccaggagucugaaugugugugccacaauggagucugucccgugguguucacagacggcagcgcuaccgggccugccgauaccagagucuacuacuuucgggagggaaaaauccugaagugggagucccuuacaggcacggcuaagcacaucgaagagugcagcugcuauggcgaacgcaccgggauuacauguaccugcagagacaacuggcagggaucuaaucggcccguuauccaaauugauccuguggccaugacacauaccucccaguacaucuguagccccgugcugacggacaacccgagaccuaaugaucccaacgucggcaaaugcaaugacccuuaucccgggaacaacaauaacggagugaagggcuucucuuaccucgaugggguuaauacauggcugggacgcaccauuagcaccgcgucccggucuggcuaugagaugcuuaaagugcccaacgcccugacagacgacagaagcaagccuauccagggccagaccaucguccucaauacagauugguccggguacagcggaucuuuuauggacuauugggcugaaggcgauuguuaccgcgccugcuucuacguggagcugauucgggggagaccgaaagaggacaagguuugguggacguccaacagcaucgugucuauguguuccagcaccgaauuucugggacaauggaauuggcccgauggcgcuaagauugaguauuuccucuga

SEQ ID NO: 206735 - RNA, 1413 nt, Artificial Sequence
  derived and/or modified sequence opt5 from neuraminidase__InfluenzaA__AGQ81967
augaaccccaaucagaagauccugugcaccagcgccacagcuauugugaucggcauuaucgccguccucauugggaucgcgaaccugggacuuaauaucggccugcaccucaaaccuuccuguaacugcucucauagccaaccggaggcuacgaaugccucccagaccauuaucaacaauuacuauaacgaaacaaauauuacccagaucucuaacacaaauauucagauggaggaaagagccagccggggguucaacaaucugaccaagggacuuuguacaaucaacuccuggcacauuuacggcaaagacaaugcuguucgcaucggggagaacucugaugugcuggugaccagagaacccuaugucagcugcgacccugaugagugucgguuuuacgcccucucccaaggaacgaccauccgcggcaagcauagcaacggcacaauucacgacagaucucaguaucgggcucugaucuccuggccccugagcucuccucccaccguguacaauucccgcguugagugcauuggguggagcucuacauccugucaugauggaaaaagcagaauguccaucugcauuucuggcccuaacaauaacgccagcgcgguggucugguauaaucggcgcccgguggccgaaaucaacaccugggcuagaaauauccuccggacgcaggaguccgaauguguuugccacaacggggugugucccgucguguucacagacggaagcgccaccggcccugcugagacacgcauuuacuacuuuaaggaggggaagauccugaaaugggaaucucuuaccggaaccgccaagcacauugaggaaugcuccugcuauggcgagagaacaggcaucacguguaccugccgggauaauuggcaggggagcaaccgccccgugauucaaaucgacccugucgcgaugacacauaccucucaguacaucuguagccccguucugacagauaauccgagaccuaacgaccccaaugugggaaaaugcaacgauccuuaucccggcaauaacaacaauggggugaagggauucuccuaccucgacggcgucaacaccuggcuggggcggacgauuucuacagccagcagauccggauaugaaaugcuuaaagugcccaaugcucugaccgaugaccgcagcaagccuauccagggccagauuaucguucucaacaccgacuggucuggcuacuccgggagcuuuauggauuauugggccgagggagacuguuaccgggcuugcuucuacguggagcugauuagaggccgcccgaaggaagauaaagucugguggacaucuaauuccaucgugagcauguguuccucuaccgaguuucuggggcaauggaacuggcccgacggagccaagauugaauauuuccucuga

SEQ ID NO: 206736 - RNA, 1413 nt, Artificial Sequence
  derived and/or modified sequence opt5 from neuraminidase__InfluenzaA__AGQ81968
augaaccccaaucagaagauccugugcaccagcgccacagcuauugugaucggcauuaucgccguccucauugggaucgcgaaccugggacuuaauaucggccugcaccucaaaccuuccuguaacugcucucauagccaaccggaggcuacgaaugccucccagaccauuaucaacaauuacuauaacgaaacaaauauuacccagaucucuaacacaaauauucagauggaggaaagagccagccggggguucaacaaucugaccaagggacuuuguacaaucaacuccuggcacauuuacggcaaagacaaugcuguucgcaucggggagaacucugauauccuggugaccagagaacccuaugugagcugcgacccugaugagugucgguuuuacgcccucucccaaggaacgaccauucgcggcaagcauagcaacggcacaauccacgacagaucucaguaucggucccugauuagcuggccccugucuuccccucccaccgucuacaauagccgcguggagugcaucggguggucuuccacaagcugucaugauggaaaauccagaaugucuauuugcaucagcggcccuaacaauaacgcuuccgccguugugugguauaaucggcgcccggucgcggaaaucaacaccugggccagaaauauucuccggacgcaggagagcgaaugugugugccacaacgggguuugucccguggucuucacagacggaucugcuaccggcccugccgagacacgcaucuacuacuuuaaggaggggaagauucugaaaugggaaucccuuaccggaaccgcuaagcacaucgaggaaugcagcugcuauggcgagagaacaggcauuacguguaccugccgggauaauuggcaggggucuaaccgccccgugauccaaaucgacccuguggccaugacacauaccagccaguacauuuguucccccguccugacagauaauccgagaccuaacgaccccaauguuggaaaaugcaacgauccuuaucccggcaauaacaacaauggggugaagggauucucuuaccucgacggcgugaacaccuggcuggggcggacgaucagcacagcguccagaagcggauaugaaaugcuuaaaguccccaaugcccugaccgaugaccgcucuaagccuauucagggccagaccaucgugcucaacacagacugguccggcuacagcgggucuuuuauugauuauugggcugagggagacuguuaccgggccugcuucuacguugagcugaucagaggccgcccgaaggaagauaaagugugguggaccuccaauagcauugucuccauguguucuagcacagaguuucuggggcaauggaacuggcccgacggagcuaagaucgaauauuuccucuga

SEQ ID NO: 206737 - RNA, 1413 nt, Artificial Sequence
  derived and/or modified sequence opt5 from neuraminidase__InfluenzaA__AGQ81969
augaaccccaaucagaagauccugugcaccagcgccacagcuauugugaucggcauuaucgccguccucauugggaucgcgaaccugggacuuaauaucggccugcaccucaaaccuuccuguaacugcucucauagccaaccggaggaaacgaaugcuucccagaccauuaucaacaauuacuauaacgagacaaauauuacccagaucucuaacacaaauauucagauggaagagagagccagccggggguucaacaaucugaccaagggacuuuguacaaucaacuccuggcacauuuacggcaaagacaaugccguucgcaucggggaaaacucugaugugcuggugaccagagagcccuaugucagcugcgacccugaugagugucgguuuuacgcucucucccaaggaacgaccauccgcggcaagcauagcaacggcacaauucacgacagaucucaguaucgggcccugaucuccuggccccugagcucuccucccaccguguacaauucccgcguugaaugcauuggguggagcucuacauccugucaugauggaaaaagcagaauguccaucugcauuucuggcccuaacaauaacgcuagcgccguggucugguauaaucggcgcccgguggcggagaucaacaccugggccagaaauauccuccggacgcaggaauccgaguguguuugccacaacggggugugucccgucguguucacagacggaagcgcuaccggcccugccgagacacgcauuuacuacuuuaaggaagggaagauccugaaaugggagucucuuaccggaaccgcuaagcacauugaagagugcuccugcuauggcgaaagaacaggcaucacguguaccugccgggauaauuggcaggggagcaaccgccccgugauucaaaucgacccugucgccaugacacauaccucucaguacaucuguagccccguucugacagauaauccgagaccuaacgaccccaaugugggaaaaugcaacgauccuuaucccggcaauaacaacaauggggugaagggauucuccuaccucgacggcgucaacaccuggcuggggcggacgauuucuacagcgagcagauccggauaugagaugcuuaaagugcccaaugcccugaccgaugaccgcagcaagccuauccagggccagauuaucguucucaacaccgacuggucuggcuacuccgggagcuuuauggauuauugggcugagggagacuguuaccgggccugcuucuacguggaacugauuagaggccgcccgaaggaggauaaagucugguggacaucuaauuccaucgugagcauguguuccucuaccgaauuucuggggcaauggaacuggcccgacggagcuaagauugaguauuuccucuga

SEQ ID NO: 206738 - RNA, 1413 nt, Artificial Sequence
  derived and/or modified sequence opt5 from neuraminidase__InfluenzaA__AGQ81970
augaaccccaaucagaagauccugugcaccagcgccacagcuauugugaucggcacgauugccguccucaucgggauugcgaaccugggacuuaauaucggccugcaccucaaaccuuccuguaacugcucucauagccaaccggaggaaaccaaugcuucccagacaaucauuaacaauuacuauaacgagaccaauaucacacagauuucuaacaccaauauccagauggaagagagagccagccggggguucaacaaucugacaaagggacuuuguaccauuaacuccuggcacaucuacggcaaagacaaugccguucgcauuggggaaaacucugaugugcuggugacgagagagcccuaugucagcugcgacccugaugagugucgguuuuacgcucucucccaaggaaccacaauccgcggcaagcauagcaacggcaccauccacgacagaucucaguaucgggcccugauuuccuggccccugagcucuccucccacaguguacaauucccgcguugaaugcaucggguggagcucuaccuccugucaugauggaaaaagcagaauguccauuugcaucucuggcccuaacaauaacgcuagcgccguggucugguauaauaagcggccgguggcggagauuaacacgugggcccgcaauauccucagaacacaggaauccgaguguguuugccacaacggggugugucccgucguguucaccgacggaagcgcuacaggcccugccgauacccggaucuacuacuuuaaggaggggaaaauucugaagugggaaccccuuaccggaacagcuaaacacaucgaggaaugcucuugcuauggcgagcgcacgggcauuaccuguacaugcagagacaauuggcagggguccaaccggccugugauccaaauugaucccgucgccaugacccauacaagccaguacaucuguucuccgguucugaccgacaauccucgccccaacgauccuaaugugggaaagugcaacgaccccuaucccggcaauagcaacaacggggugaaaggauucuccuaccucgauggcgucaauacguggcuggggagaacaaucucuaccgcgagccgguccggauaugaaaugcuuaaggugccuaacgcccugaccgacgacagaagcaagccgauucagggccagacaaucguucucaauaccgauuggucuggcuacuccgggagcuuuauggacuauugggcugagggagauuguuaccgcgccugcuucuacguggagcugauucggggcagacccaaagaagacaaggucugguggacaucuaacuccaucgugagcauguguuccucuacggaguuucuggggcaauggaauuggccugauggagcuaaaauugaauauuuccucuga

SEQ ID NO: 206739 - RNA, 1413 nt, Artificial Sequence
  derived and/or modified sequence opt5 from neuraminidase__InfluenzaA__AGQ81971
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuacccagaucucuaacacaaauauucagauggaggaaagaaccagccggggguucaacaaucugacgaagggacuuuguaccaucaacuccuggcacauuuacggcaaagacaaugccguccgcaucggggagucuagcgauguucuggugacaagagaacccuauguguccugcgacccugaugagugucgguuuuacgcccucagccaaggaaccacaauccgcggcaagcauucuaacggcaccauucacgacagaucccaguaucgggcucugaucagcuggccccugucuuccccucccacggucuacagcucucgcguggagugcauugggugguccagcacauccugucaugauggaaaaucuagaaugagcaucugcauuuccggcccuaacaauaacgccagcgcuguugugugguauaaucggcgcccggucgccgaaaucaacaccugggcgagaaauauccuccggacacaggagucugaaugugugugccacaacgggguuugucccguggucuucaccgacggauccgccaccggcccugcugauacacgcauuuacuacuuuaaggaggggaagauccugaaaugggagagccuuacgggaaccgccaagcacauugaagagugcucuugcuauggcgaaagaacaggcaucaccuguacaugccgggacaauuggcaggggagcaaccgccccgugauucaaaucgauccuguggcuaugacccauacgucccaguacaucuguucucccguccugacagacaauccgagaccuaacgaucccaauauuggaaaaugcaacgacccuuaucccggcaauaacaauaacgggguuaagggauucagcuaccucgauggcgccaacaccuggcuggggcggaccaucuccacagcgagcagaucuggauaugagaugcuuaaagugcccaaugcccugaccgacgaccgcuccaagccuauucagggccagacaaucgugcucaacacggauuggagcggcuacucuggguccuuuauggacuauugggcugaaggagauuguuaccgggccugcuucuacgucgagcugauuagaggccgcccgaaggaggacaaagugugguggaccagcaauuccaucguuucuauguguagcuccacagaauuucuggggcaauggaacuggcccgauggagcuaagauugaguauuuccucuga

SEQ ID NO: 206740 - RNA, 1413 nt, Artificial Sequence
  derived and/or modified sequence opt5 from neuraminidase__InfluenzaA__AGQ81972
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuacccagaucucuaacacaaauauucagauggaggaaagagccagccggggguucaacaaucugaccaagggacuuuguacgaucaacuccuggcacauuuacggcaaagacaaugccguccgcaucggggagucuagcgauguucuggugaccagagaacccuauguguccugcgacccugaugagugucgguuuuacgcucucagccaaggaacaaccauccgcggcaagcauucuaacggcacaauucacgacagaucccaguaucgggcccugaucagcuggccccugucuuccccucccaccgucuacaacagccgcguggagugcauuggguggucuuccacgagcugucaugauggaaaauccagaaugucuaucugcauuagcggcccuaauaacaaugcuuccgccguugugugguauaaccggcgcccggucgcggaaaucaauacaugggccagaaacauccuccggacccaggagagcgaaugugugugccacaaugggguuugucccguggucuucacagacggaucugcuaccggcccugccgauacccgcauuuacuacuuuaaggaggggaagauccugaaaugggagucccuuacaggaacggcuaagcacauugaagagugcagcugcuauggcgaaagaaccggcaucacauguaccugccgggacaacuggcaggggucuaaucgccccgugauucaaaucgauccuguggccaugacacauaccagccaguacaucuguucccccguccugacggacaacccgagaccuaaugaucccaacauuggaaaaugcaaugacccuuaucccggcaacaauaacaacgggguuaagggauucucuuaccucgauggcgcgaauacauggcuggggcggaccaucagcaccgccuccagaagcggauaugagaugcuuaaagugcccaacgcucugacagacgaccgcucuaagccuauucagggccagaccaucgugcucaauacagauugguccggcuacagcgggucuuuuauggacuauugggccgaaggagauuguuaccgggcuugcuucuacgucgagcugauuagaggccgcccgaaggaggacaaagugugguggacguccaacagcaucguuuccauguguucuagcaccgaauuucuggggcaauggaauuggcccgauggagccaagauugaguauuuccucuga

SEQ ID NO: 206741 - RNA, 1413 nt, Artificial Sequence
  derived and/or modified sequence opt5 from neuraminidase__InfluenzaA__AGQ81973
augaaccccaaucagaagauccugugcaccagcgccacagcuauuaucauuggcgccaucgcggugcucauugggaucgcuaaccugggacuuaauaucggccugcaccucaaaccuuccuguaacugcucucauagccaaccggagacgaccaauacaucccagaccauuaucaacaauuacuauaacgaaacaaauauuacccagaucucuaacacaaauauucagauggaggaaagaaccagccggggguucaacaaucugacgaagggacuuuguaccaucaacuccuggcacauuuacggcaaagacaaugccguccgcaucggggagucuagcgauguucuggugacaagagaacccuauguguccugcgacccugaugagugucgguuuuacgcccucagccaaggaaccacaauccgcggcaagcauucuaacggcaccauucacgacagaucccaguaucgggcucugaucagcuggccccugucuuccccucccacggucuacaacagccgcguggagugcauuggguggucuuccacaagcugucaugauggaaaauccagaaugucuaucugcauuagcggcccuaauaacaaugccuccgcuguugugugguauaaccggcgcccggucgccgaaaucaauaccugggcgagaaacauccuccggacacaggagagcgaaugugugugccacaaugggguuugucccguggucuucaccgacggaucugccaccggcccugcugauacacgcauuuacuacuuuaaggaggggaagauccugaaaugggagucccuuacgggaaccgccaagcacauugaagagugcagcugcuauggcgaaagaacaggcaucaccuguacaugccgggacaacuggcaggggucuaaucgccccgugauucaaaucgauccuguggcuaugacccauacgagccaguacaucuguucccccguccugacagacaacccgagaccuaaugaucccaacauuggaaaaugcaaugacccuuaucccggcaacaauaacaacgggguuaagggauucucuuaccucgauggcgccaauaccuggcuggggcggaccaucagcacagcguccagaagcggauaugagaugcuuaaagugcccaacgcccugaccgacgaccgcucuaagccuauucagggccagacaaucgugcucaauacggauugguccggcuacagcgggucuuuuauggacuauugggcugaaggagauuguuaccgggccugcuucuacgucgagcugauuagaggccgcccgaaggaggacaaagugugguggaccuccaacagcaucguuuccauguguucuagcacagaauuucuggggcaauggaauuggcccgauggagcuaagauugaguauuuccucuga

SEQ ID NO: 206742 - RNA, 1413 nt, Artificial Sequence; identical to SEQ ID NO: 206722
  derived and/or modified sequence opt5 from neuraminidase__InfluenzaA__AGQ81974

SEQ ID NO: 206743 - RNA, 1398 nt, Artificial Sequence
  derived and/or modified sequence opt5 from neuraminidase__InfluenzaA__AGQ81975
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaaguggcuuuguacgauuaacucuuggcacaucuacggaaaagacaaugccguccgcauuggcgagaacagcgauguucuggugaccagagaacccuauguguccugcgacccugaugagugucgguuuuacgcccucucucaggggacaaccauccgcggaaagcauagcaacggcacaauccacgacagaucccaauaucgggcucugauuagcuggccccugucuuccccucccaccgucuacaauagccgcguggagugcaucggcuggucuuccacgagcugucaugaugggaaaucuagaauguccauuugcaucagcggaccuaacaauaacgccuccgcuguugugugguauaaucggcgcccggucgccgaaauuaacacaugggcgagaaauauccuccggacccaggagucugaaugugugugccacaacggcguuugucccguggucuucacagacgggagcgccaccggaccugcugauacccgcaucuacuacuuuaaggagggcaagauucugaaaugggagucccuuacagggacggccaagcacaucgaagagugcagcugcuauggagaaagaaccggcauuacauguaccugccgggacaauuggcagggcucuaaccgccccgugauccagauugauccuguggcuaugacacauaccucccaauacaucuguagccccguccugacggacaauccgagaccugaugaccccaacaucgggaaaugcaaugauccuuaucccggaaacaauaacaacggcguuaagggguucucuuaccucgacggagccaauacauggcugggccggaccauuagcaccgcguccagaucuggguaugagaugcuuaaagugcccaacgcccugacagacgaucgcagcaagccuauccagggacagaccauugugcucaaugcugacugguccggcuacagcggcucuuuuauggauuauugggccgacggggauuguuaccgggcuugcuucuacgucgaacugaucagaggacgcccgaaggaggacaaagugugguggacauccaacagcauuguuucuauguguuccagcacggaguuucugggccaguggaauuggcccgauggggccaagaucgaauauuuccucuga

SEQ ID NO: 206744 - RNA, 1398 nt, Artificial Sequence
  derived and/or modified sequence opt5 from neuraminidase__InfluenzaA__AGQ81977
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccguccgcauuggggagagcuccgauguucuggugaccagagaacccuaugugucuugcgacccugaugagugucgguuuuacgcccucagccagggaacaaccauccgcggcaagcauuccaacggcacaauccacgacagaagccaauaucgggcucugauuucuuggccccuguccagcccucccaccgucuacaacucucgcguggagugcaucgggugguccagcacgucuugucaugauggaaaauccagaaugagcauuugcaucuccggcccuaauaacaaugccucugcuguugugugguauaaccggcgcccggucgccgaaauuaauacaugggcgagaaacauccuccggacccaggagagcgaaugugugugccacaaugggguuugucccguggucuucacagacggauccgccaccggcccugcugauacccgcaucuacuacuuuaaggaggggaagauucugaaaugggagagccuuacaggaacggccaagcacaucgaagagugcucuugcuauggcgaaagaaccggcauuacauguaccugccgggacaacuggcagggguccaaucgccccgugauccagauugauccuguggcuaugacacauaccagccaauacaucuguucucccguccugacggacaacccgagaccugaugaccccaauaucggaaaaugcaacgauccuuaucccggcaauaacaauaacgggguuaagggauucagcuaccucgacggcgccaacacauggcuggggcggaccauuuccaccgcgucuagaagcggauaugagaugcuuaaagugcccaaugcccugacagacgaucgcuccaagccuauccagggccagaccauugugcucaacgcugacuggagcggcuacucuggguccuuuauggauuauugggccgacggagauuguuaccgggcuugcuucuacgucgaacugaucagaggccgcccgaaggaggacaaagugugguggacaagcaauucuauuguuuccauguguagcuccacggaguuucuggggcaguggaacuggcccgauggagccaagaucgaauauuuccucuga

SEQ ID NO: 206745 - RNA, 1398 nt, Artificial Sequence
  derived and/or modified sequence opt5 from neuraminidase__InfluenzaA__AGQ81979
augaaccccaaucagaagauccugugcaccagcgccacagcuauuaucauuggcgccaucgcggcucucauugggaucgccaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccgugcgcauuggggagagcuccgauguccugguuaccagagaacccuaugugucuugcgacccugaugagugucgguuuuacgcucucagccagggaacaaccauccgcggcaagcauuccaacggcacaauccacgacagaagccaauaucgggcccugauuucuuggccccuguccagcccucccaccguguacaacucucgcgucgagugcaucgggugguccagcacgucuugucaugauggaaaauccagaaugagcauuugcaucuccggcccuaauaacaaugcuucugccgugguuugguauaaccggcgcccgguggcggaaauuaauacaugggccagaaacauccuccggacccaggagagcgaaugugucugccacaauggggugugucccguuguguucacagacggauccgcuaccggcccugccgauacccgcaucuacuacuuuaaggaggggaagauucugaaaugggagagccuuacaggaacggcuaagcacaucgaagagugcucuugcuauggcgaaagaaccggcauuacauguaccugccgggacaacuggcagggguccaaucgccccgucauccagauugauccuguggccaugacacauaccagccaauacaucuguucucccgugcugacggacaacccgagaccugaugaccccaauaucggaaaaugcaacgauccuuaucccggcaauaacaauaacggggucaagggauucagcuaccucgacggcgcgaacacauggcuggggcggaccauuuccaccgccucuagaagcggauaugagaugcuuaaaguucccaaugcucugacagacgaucgcuccaagccuauccagggccagaccauugugcucaacgccgacuggagcggcuacucuggguccuuuauggauuauugggcugacggagauuguuaccgggccugcuucuacguggaacugaucagaggccgcccgaaggaggacaaagucugguggacaagcaauucuauuguguccauguguagcuccacggaguuucuggggcaguggaacuggcccgauggagccaagaucgaauauuuccucuga

SEQ ID NO: 206746 - RNA, 1398 nt, Artificial Sequence; identical to SEQ ID NO: 206744
  derived and/or modified sequence opt5 from neuraminidase__InfluenzaA__AGQ81980

SEQ ID NO: 206747 - RNA, 1350 nt, Artificial Sequence
  derived and/or modified sequence opt5 from neuraminidase__InfluenzaA__AGQ88501
augaaccccaaucagaagaucgugaccauuggcagcaucugcauggucauugggaucguuucccugaugcuccaaauuggaaacaugaucucuaucugggugagccacuccauucagacaggcaaucagcaucagacggagccuaucagaaacaccaauuuccugacagaaaacgccguggcuucugucgcccuuagcggaaauuccucucuguguccgauucgggggugggcggugcacagcaaagacaacuccauccgcauuggcagcaagggggauguuuuugugaucagagagcccuucauuucuugcuccaaucucgaaugucggaccuuuuuccugacacaaggagcccuucugaacgacaaacauagcaauggcaccgucaaggaucgcucuccucacagaacacucauguccugccccaucggcgaggcuccuagccccuacaacucucgguuugaauccguggccuggagcgcuuccgccugucaugacgggaucucuuggcugaccauuggaaucagcggcccugauaauggggcuguugccgugcugaaauauaacggaauuaucacggacaccauuaaguccuggcgcaauaacauccucagaacacaggagagcgagugcaccugugucaacggcucuugcuucacagugaugaccgaugggccguccaauggacaggcgagcuacaagaucuuuaaaauugaaaagggcaaaguggucaagucuguugagcugaacgcccccaauuaucacuacgaagaguguagcugcuauccugacgcuggcgagaucauuugugugugccgggauaacuggcacggguccaaucgccccugggugucuuucaaccagaaucuugaauaccaaaucggauauauuugcagcggcgucuuuggggacaacccuagacccaaugauggagagggcuccugugggccggugagcccuaacggagccuacggcguuaaaggcuucucuuuuaaguacgggaauggaguguggaucggccggacgaaguccacacauagccgcucuggguucgaaaugaucugggaccccaacggauggaccggcacagauuccgaguuuagcaugaaacaggacauugucgcuaucaccgacugguccggguauucuggcagcuucgugcagcacccugaacugaccggacucgauugcauuagacccuguuucuggguugagcugauccggggccgccccaaggaguccacaauuuggacgucugggagcuccaucagcuuuugcggagucaauucugacaccguguccuggagcuggccugauggcgccgaacuuccguucacaauugacaaauga

SEQ ID NO: 206748 - RNA, 1401 nt, Artificial Sequence; identical to SEQ ID NO: 206626
  derived and/or modified sequence opt5 from neuraminidase__InfluenzaA__AGR33906

SEQ ID NO: 206749 - RNA, 1401 nt, Artificial Sequence
  derived and/or modified sequence opt5 from neuraminidase__InfluenzaA__AGR33908
augaaccccaaucagaagaucaccgccauuggcagcgugucccugaucauugcuaucauuugccuccugaugcaaaucgccauccuuacaacgaccaugacacugcacuucagacagaacgaguguucuaauccuagcaacaaucaggucaugccgugcgaacccauuaucauugagcggaacaccguucaucucaauuccacaaccaucgaacgcgagauuuguccuaaaguggcggaauacaagaacuggucuaaaccccagugccaaaucacaggguuugcuccuuucagcaaggacaauuccauuagacugucugccggaggcgauaucugggugacccgggagcccuaugucagcuguuccccugacaaaugcuaccaguuugcccuugggcagggaacgacccugaagaacaagcacagcaauggcacaacccaugaucgcacaccgcacagaacccuccugaugaacgagcugggggugcccuuccaucucggaacgaaacagguuuguaucgcuuggucuuccagcucuugcuaugacggcaaggccuggcugcacauuugugugacaggcgaugacaaaaaugcuaccgccuccaucauuuacgaugggaugcuugucgacagcaucggaucuugguccaagaacauucugcggacacaagaaagcgagugcguguguaucaaugggaccugcgcgguugugaugaccgauggcuccgccucuggagaagcugacacacgcauccucuuuauuagagagggcaaaaucauuaacaucagcccucuguccgggagcgcccagcacgucgaggaaugcucuuguuauccccgguacccugaggugcgcugcguguguagagauaacuggaagggauccaaucggcccauuaucuauaucaacauggucgacuacagcauugaaucucgcuacguuugcagcggccuugugggcgauacgccgagaaaugacgacuccaccucuagcuccaacugucgggauccuaauaacgagcgcggggcucccggagugaagggcugggccuucgacgaugggaaugacgucuggaugggaagaacaaucaaaaacggcagccggucuggguaugaaaccuuuagagugauuaauggauggacaauggcgaacuccaagagccagaucaaucgccagguuauuguggauucugacaacugguccggcuacagcggcaucuucuccgucgaggggaaaaagugcauuaaucgguguuuuuauguggagcugaucagaggacgcccucaagaaccccggguuugguggaccucuaacagcaucauuguguucugcggcacguccgggacauacggaaccggcucuuggcccgauggggccgacaucaauuuuaugccuauuuga

SEQ ID NO: 206750 - RNA, 1401 nt, Artificial Sequence
  derived and/or modified sequence opt5 from neuraminidase__InfluenzaA__AGR33910
augaaccccaaucagaagaucauugccaucggcagcgugucccugaccauugcuaucauuugcuuccucaugcaaaucgccauccugacaacgaccaugacacuucacuuuaaacagaacgaguguucuaagccuagcaauaaccaggucguuccgugcgaacccauucugaucgagagaaauaccgugcaucucaacuccacaaccauugaaaaagagguguguccuaaggucgcggaauacaaaaauuggucuaagccccagugccaaaucacaggguucgcuccuuuuagcaaggacaacuccauucggcugucugccggaggcgauaucugggugacccgcgagcccuauguuagcuguuccuucgggaaaugcuaccaguuugcccuuggacagggcacgacccugaagaauaaacacagcaacgggacaacccaugacagaacaccucaccggacccuccugaugaaugagcugggagugccguuccaucucggcacgaagcaggucuguauugcuuggucuuccagcucuugcuaugauggcaaagccuggcugcacaucugugugacaggggacgauaagaacgcuaccgccuccaucauuuacgacggaaugcuuguugauagcaucggcucuugguccaagaauauucugcgcacacaagaaagcgagugcguguguaucaacgggaccugcgcggucgugaugaccgacggauccgccucuggcaaagcugauacacggauucucuuuaucagagaagggaagaucauuaauauccgcccccugagcggauccgcccagcacguggaggagugcagcuguuauccuagauaccccgaaguccggugcguuugucgcgacaacuggaaaggcucuaacagaccugugcuuuauauuaauauggcugauuacuccguggagagcucuuacgucugcagcggccuggugggggacacgccccggaacgaugacuccucuagcuccagcaauugucgcgacccgaacaaugaaagaggagccccuggcguuaaggggugggcguucgaugacggaaacgauguguggaugggccggaccauccgcaaugacucuagauccggguaugagacauuucgggucgugaacggauggaccacagccaauagcaaaucucagauuaacagacagguuaucguggauuccgaaaauuggagcggcuacuccggcaucuucucugucgaggggaagaacugcauuaaucgcuguuuuuauguggagcucauccggggaagaccccaagaaccucgcgucugguggaccagcaacuccauuaucguguucugcggcacgucugggacauacggaaccggcagcuggcccgacggggcuaauauuaacuuuaugcccaucuga

SEQ ID NO: 206751 - RNA, 1401 nt, Artificial Sequence
  derived and/or modified sequence opt5 from neuraminidase__InfluenzaA__AGR33911
augaaccccaaucagaagaucauugccaucggcagcgugucccugaccauugcuaucauuugcuuccucaugcaaaucgccauccugacaacgaccaugacacuucacuuuaaacagaacgaguguucuaauccuagcaacaaucaggucguuccgugcgaacccauucugaucgagagaaacaccgugcaucucaauuccacaaccauugaaaaggagguguguccuaaagucgcggaauacaagaacuggucuaaaccccagugccaaaucacaggguucgcuccuuuuagcaaggacaauuccauucggcugucugccggaggcgauaucugggugacccgcgagcccuauguuagcuguucccuugggaagugcuaccaguucgcccugggacagggcacgacccucaaaaacaaucacagcaacgggacaacccaugacagaacaccucaccggacccugcugaugaaugagcucggagugccguuucaucugggcacgaagcaggucuguauugcuuggucuuccagcucuugcuaugauggcaaagccuggcuucacaucugugugacaggggacgauaagaacgcuaccgccuccaucauuuacgacggaaugcugguugauagcaucggcucuugguccaaaaauauucuccgcacacaagaaagcgagugcguguguaucaacgggaccugcgcggucgugaugaccgacggauccgccucuggcaaggcugauacacggauucuguucauccgggaagggaagaucauuaacaucagcccccuuuccggaagcgcccagcacguggaggagugcucuuguuauccucgcuaccccgaagucagaugcguuugucgggacaauuggaaaggcuccaaccgcccugugcuguauauuaauauggcugauuacagcaucgagucuagcuacgugugcuccggccucgucggggacacgcccagaaacgaugacucuagcuccagcucuaauugucgggacccgaacaaugaacgcggagccccuggcgugaaggggugggcguuugaugacggaaacgauguuuggaugggcagaaccauucggaauaacucccgcagcggguaugagacauucagaguggucaauggauggaccacagccaacucuaaaucccagaucaauagacaggugaucguugacagcgaaaacugguccggcuacucuggcauuuuuagcguggaggggaagaauugcaucaacagauguuucuaugucgagcugauucgcggacggccccaagaaccuagagugugguggaccuccaacucuaucauugucuuuugcggcacgagcgggacauacggaaccggcuccuggcccgauggggcuaauaucaacuucaugcccauuuga

SEQ ID NO: 206752 - RNA, 1356 nt, Artificial Sequence; identical to SEQ ID NO: 206667
  derived and/or modified sequence opt5 from neuraminidase__InfluenzaA__AGR33912

SEQ ID NO: 206753 - RNA, 1356 nt, Artificial Sequence; identical to SEQ ID NO: 206697
  derived and/or modified sequence opt5 from neuraminidase__InfluenzaA__AGR33913

SEQ ID NO: 206754 - RNA, 1356 nt, Artificial Sequence; identical to SEQ ID NO: 206667
  derived and/or modified sequence opt5 from neuraminidase__InfluenzaA__AGR33915

SEQ ID NO: 206755 - RNA, 1356 nt, Artificial Sequence
  derived and/or modified sequence opt5 from neuraminidase__InfluenzaA__AGR33916
augaaccccaaucagaagcuguucgccagcuccggcguggcuaucgcccucucuguccugaaccuucugauugggcucagcaauguuggacugaacgugucccuucaccugaaagagaccggcccuaagcaagaagagaaucucacaugcaugacgaccaaagaaacagagcuggggaccccgucuuaccugcuccugaacaagagccuuuguaauguggaaggaugggucgugaucgcgaaagacaacgcuguuagauuuggcgaguccgagcagauuaucauuacacgggaacccuaugugucuugcgauccuaauggguguaagauguacgcccugcaucagggaaccacaauccgcaacaagcacagcaauggcaccauccaugacagaacggccuuccggggccucauuuccacaccccuggggaccccucccaccgucagcaacucugauuuuaucugcgugggaugguccagcacaaccugucacgacggcauugggcgcaugacgaucugcauucagggaaauaacgauaaugcuacagccaccguuuauuacaacagacggcuuacaaccaccaucaaaacaugggcucgcaacauucugagaacgcaagagucugaaugugugugccauaauggcaccugugccgucgugaugacagacggguccgcgagcucucaggcccacaccaaggugauguauuuccacaaaggacucgucguuaaggaggaggcucugaaaggcuccgccaagcauaucgaagagugcagcuguuacggccacaaccagaaggugacaugcgugugccgggauaauuggcagggggcuaaccgcccuaucauugaaaucgacaugaauacccuggagcauacguccagauaugucuguacaggcauucucaccgauaccucucggccgggagacaaacccacaggggauugcagcaacccuaucaccggaucccccggcgccccuggggugaagggauuuggcuuccugaauggcgacaacacauggcuugggcgcacgauuagccccagaucucgguccggauuugaaaugcugaaaaucccgaaugcgggcaucgauccuaacagccgcauugccgagagacaagagaucguugacaauucuaacuggagcggguacuccggaucuuucauugacuacuggaaugauaacagcgaauguuauaaucccugcuuuuacguggagcucauccggggcagaccugaagaggcuaaguaugucugguggaccuccaacagccugauugcccuuugugggucucccuuccccgugggcuccggcagcuuuccugacggagcucagauccaguacuucucuuga

SEQ ID NO: 206756 - RNA, 1356 nt, Artificial Sequence; identical to SEQ ID NO: 206697
  derived and/or modified sequence opt5 from neuraminidase__InfluenzaA__AGR33917

SEQ ID NO: 206757 - RNA, 1356 nt, Artificial Sequence; identical to SEQ ID NO: 206667
  derived and/or modified sequence opt5 from neuraminidase__InfluenzaA__AGR33918

SEQ ID NO: 206758 - RNA, 1398 nt, Artificial Sequence; identical to SEQ ID NO: 206744
  derived and/or modified sequence opt5 from neuraminidase__InfluenzaA__AGR33919

SEQ ID NO: 206759 - RNA, 1413 nt, Artificial Sequence
  derived and/or modified sequence opt5 from neuraminidase__InfluenzaA__AGR45094
augaaccccaaucagaagaucauuaccaucggcagcauuuccauggccaucgggauuaucucucugauccuccaaauuggaaacaucauuagcaucugggcuucccacucuauucagacaggcagccagaaucauacggggaucugcaaccagagaauuaucaccuacgaaaauuccacaugggugaaccaaaccuaugucaauaucaacaauacaaacguuguggccggaaaagacaagaccucugugacacuggcgggcaauagcucccuuuguccuauucgggggugggcuaucuacaccaaagauaacagcauucgcaucggaucuaagggcgacgucuucgugauuagagagccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggcaugggguggcugaccaucggaauuagcggccccgacaacggggcggucgccgugcugaaguauaacggaaucauuacagaaaccaucaaauccuggaagaaacgcauucucagaacgcaggagagcgagugcguuugugugaauggcucuugcuuuacaaucaugaccgauggcccuuccaacgggccggcuagcuaccggaucuucaagauugaaaaaggaaagaucacaaagucuauugagcuggacgcccccaauuaucauuacgaagaguguagcugcuacccugauaccggcaccgucaugugugugugccgcgacaacuggcacggguccaauagacccugggugucuuuuaaccagaaucuugauuaucaaaucggauacauuugcagcggcgucuucggggacaacccucggcccaaagauggagagggcuccuguaauccgguuacaguggacggcgcugacggggugaagggauuuagcuaucgcuacggcaacggggucuggaucggaagaacgaaaucuaauuccagccggaagggcuucgaaaugauuugggauccuaacggguggaccgacacagauucugacuuuuccgugaaacaggauguugugcccaugaccgacuggagcggcuauuccggaucuuucguccagcacccugagcugacaggccucgauugcaugcgccccuguuuuuggguggaacugaucagagggcggcccagagagaauaccacgaucuggacaagcggauccucuauuagcuucugcggcguuaacuccgacaccgccaauuggagcuggccugaugacgcggaacuuccgcugaccaucgauaaguga

SEQ ID NO: 206760 - RNA, 1413 nt, Artificial Sequence; identical to SEQ ID NO: 201954
  derived and/or modified sequence opt5 from neuraminidase__InfluenzaA__AGR49780

SEQ ID NO: 206761 - RNA, 1410 nt, Artificial Sequence
  derived and/or modified sequence opt5 from neuraminidase__InfluenzaA__AGR49804
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuaccggaaauucuagccugugcccuguuuccggcugggcgauuuacagcaaggacaacucugugagaaucggguccaaaggagaugucuuugugauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggagguuccuucccccuacaacagccgcuuugaauccguggcuuggucugccagcgcuugccacgacggaaucaauuggcugacaauuggcaucuccgggccugauaacggagccgucgcugugcugaaguauaauggcaucauuaccgacacaaucaagagcuggagaaacaauauucuccggacccaagagucugagugugccugcgugaacggguccuguuucacggucaugacagauggaccgagcaauggccaggcgucuuacaaaaucuuucgcauugaaaagggcaaaaucguuaagagcguggagaugaacgcccccaauuaucauuacgaagagugcuccuguuacccugacucuagcgagauuaccugcgugugcagagauaacuggcacggguccaaucggcccugggucagcuucaaccagaaucuggaauaucagaucggauacaucuguucuggcauuuuuggggacaacccucgccccaaugauaaaacaggauccugcggcccggugagcucuaacggggcuaacggaguuaagggcuucuccuuuaaguauggcaaugggguguggaucggaagaaccaaaagcauuuccucucggaacggcuucgagaugaucugggacccuaauggguggaccggaacagauaacaauuuuagcauuaagcaagacaucgucggcaucaacgaaugguccggguacucuggcagcuucgugcagcaucccgagcuuacgggacuggacuguauucgcccuugcuucuggguugaacucaucagaggccggcccaaagagaauaccauuuggacauccgggagcucuaucuccuuuuguggagugaacagcgauaccgucggcuggucuuggcccgacggggccgagcugccuuucacaauugauaaguga

SEQ ID NO: 206762 - RNA, 1413 nt, Artificial Sequence; identical to SEQ ID NO: 201954
  derived and/or modified sequence opt5 from neuraminidase__InfluenzaA__AGR49820

SEQ ID NO: 206763 - RNA, 1410 nt, Artificial Sequence; identical to SEQ ID NO: 199114
  derived and/or modified sequence opt5 from neuraminidase__InfluenzaA__AGR49832

SEQ ID NO: 206764 - RNA, 1413 nt, Artificial Sequence; identical to SEQ ID NO: 201954
  derived and/or modified sequence opt5 from neuraminidase__InfluenzaA__AGR49844

SEQ ID NO: 206765 - RNA, 1413 nt, Artificial Sequence; identical to SEQ ID NO: 201954
  derived and/or modified sequence opt5 from neuraminidase__InfluenzaA__AGR49856

SEQ ID NO: 206766 - RNA, 1413 nt, Artificial Sequence; identical to SEQ ID NO: 201954
  derived and/or modified sequence opt5 from neuraminidase__InfluenzaA__AGR49868

SEQ ID NO: 206767 - RNA, 1410 nt, Artificial Sequence; identical to SEQ ID NO: 199752
  derived and/or modified sequence opt5 from neuraminidase__InfluenzaA__AGR49880

SEQ ID NO: 206768 - RNA, 1410 nt, Artificial Sequence; identical to SEQ ID NO: 201508
  derived and/or modified sequence opt5 from neuraminidase__InfluenzaA__AGR49891

SEQ ID NO: 206769 - RNA, 1410 nt, Artificial Sequence
  derived and/or modified sequence opt5 from neuraminidase__InfluenzaA__AGR49903
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccagcagcuccugucacgauggaaaagccuggcugcaugugugcaucacaggcgacgauaagaaugcuaccgccagcuucauuuacaacggcagacuuguugacucuaucguguccuggagcaaagagauucugcggacccaggaaucugagugugucugcaucaaugggacauguacgguggugaugaccgauggauccgcuagcggcaaggccgacacaaaaauccucuuuauugaggaagggaagaucguccacaccuccacacugucuggaagcgcgcaacacguugaggaaugcuccugcuauccucgcuaccccggcgugagaugugugugccgggauaacuggaaggggagcaaccgcccuauugucgacaucaauauuaaagaccauucuaucguguccagcuacguuuguucuggacuugugggcgauacccccagaaagaacgacagcuccucuagcggccacugccuggauccgaauaacgaggaagggggacauggcgucaaagggugggccuucgacgauggaaaugacguguggaugggccggacgaucuccgagaagucucgccucggguaugagacauuuaaaguuauugaaggauggucuaacccuaaguccaaacugcagaucaauagacaggugauugucgaucggggcaaccgcagcggcuacucugggaucuucuccguggagggaaagagcuguauuaauagaugcuuuuaugucgaacugauccggggcagaaaggaggaaaccgaggugcucuggaccuccaacucuauuguuguguucugugggacaagcggaaccuacggcacaggguccuggcccgacggcgcugauaucaaucugaugccuaucuga

SEQ ID NO: 206770 - RNA, 1410 nt, Artificial Sequence; identical to SEQ ID NO: 199114
  derived and/or modified sequence opt5 from neuraminidase__InfluenzaA__AGR49915

SEQ ID NO: 206771 - RNA, 1410 nt, Artificial Sequence; identical to SEQ ID NO: 199114
  derived and/or modified sequence opt5 from neuraminidase__InfluenzaA__AGR49927

SEQ ID NO: 206772 - RNA, 1410 nt, Artificial Sequence
  derived and/or modified sequence opt5 from neuraminidase__InfluenzaA__AGR49939
augaaccccaauaagaaaaucauuaccaucggcagcgugucccugacaauuucuacgaucugcuucuuuaugcagauugccauccucaucaccacagucacccugcacuucaagcaauacgaguuuaacagcccuccgaauaaccagguuaugcuuugugaacccacaauuaucgagagaaauauuaccgaaaucguguaucugacaaacaccacgauugagaaagaaaucugcccuaagcucgcugaguaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaguucgcucuugggcaaggaaccacacugaauaacgugcauagcaaugauaccguucgggaccgcacgccguauagaacacuccugaugaacgaacugggcgugcccuuucaccucgggaccaaacaggucugcauugccugguccucuagcuccugucaugauggaaaggccuggcugcacgugugcaucacaggcgacgauaaaaaugcuaccgccagcuucauuuacaacggccggcuuguugacucuaucguguccuggagcaaggagauucugcgcacccaggaaucugagugugucugcaucaaugggacauguacgguggugaugaccgauggauccgcuagcggcaaagccgacacaaagauccucuuuauugaggaagggaagaucguccauaccuccacacugucuggaagcgcgcagcacguugaggaaugcuccugcuauccuagauaccccggcgugcggugugugugccgcgauaacuggaaagggagcaacagaccuauugucgacaucaauauuaaggaccacucuaucguguccagcuacguuuguucuggacuugugggcgauacgccccggaaaaacgacagcuccucuagcggccauugccuggauccgaauaacgaggaagggggacacggcgucaaggggugggccuucgacgauggaaaugacguguggaugggccgcaccaucuccgagaaaagcagacucggguaugagacauuuaagguuauugaaggauggucuaacccuaaauccaagcugcaaaucaaucgccaggugauugucgaucggggcaacagaagcggcuacucugggaucuucuccguggagggaaagagcuguauuaaucggugcuuuuaugucgaacugaucagaggccgcaaagaggaaaccgaggugcucuggaccuccaacucuauuguuguguucugugggacaagcggaaccuacggcacaggguccuggcccgacggcgcugauaucaaucugaugccuaucuga

SEQ ID NO: 206773 - RNA, 1410 nt, Artificial Sequence; identical to SEQ ID NO: 199709
  derived and/or modified sequence opt5 from neuraminidase__InfluenzaA__AGR49951

SEQ ID NO: 206774 - RNA, 1410 nt, Artificial Sequence
  derived and/or modified sequence opt5 from neuraminidase__InfluenzaA__AGR49963
augaaccccaauaagaaaaucauuaccaucggcagcgugucccugacaauuucuacgaucugcuucuuuaugcagauugccauccucaucaccacagucacccugcacuucaagcaauacgaguuuaacagcccuccgaauaaccagguuaugcuuugugaacccacaauuaucgagagaaauauuaccgaaaucguguaucugacaaacaccacgauugagaaagaaaucugcccuaagcucgcugaguaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaguucgcucuugggcaaggaaccacacugaauaacgugcauagcaaugauaccguucgggaccgcacgccguauagaacacuccugaugaacgaacugggcgugcccuuucaccucgggaccaaacaggucugcauugccugguccucuagcuccugucaugauggaaaggccuggcugcacgugugcaucacaggcgacgauaaaaaugcuaccgccagcuucauuuacaacggccggcuuguugacucuaucguguccuggagcaaggagauucugcgcacccaggaaucugagugugucugcaucaaugggacauguacgguggugaugaccgauggauccgcuagcggcaaagccgacacaaagauccucuuuauugaggaagggaagaucguccauaccuccacacugucuggaagcgcgcagcacguugaggaaugcuccugcuauccuagauaccccggcgugcggugugugugccgcgauaacuggaaagggagcaacagaccuauugucgacaucaauauuaaggaccacucuaucguguccagcuacguuuguucuggacuugugggcgauacgccccggaaaaacgacagcuccucuagcggccauugccuggauccgaauaacgaggaagggggacacggcgucaaggggugggccuucgacgauggaaaugacguguggaugggccgcaccaucuccaaaaagagcagacucggguaugagacauuuaaaguuauugagggauggucuaacccuaaguccaagcugcaaaucaaucgccaggugauugucgaucggggcaacagaagcggcuacucugggaucuucuccguggaaggaaaaagcuguauuaaucggugcuuuuaugucgagcugaucagaggccgcaaggaagagaccgaagugcucuggaccuccaacucuauuguuguguucugugggacaagcggaaccuacggcacaggguccuggcccgacggcgcugauaucaaucugaugccuaucuga

SEQ ID NO: 206775 - RNA, 1410 nt, Artificial Sequence; identical to SEQ ID NO: 199752
  derived and/or modified sequence opt5 from neuraminidase__InfluenzaA__AGR49975

SEQ ID NO: 206776 - RNA, 1413 nt, Artificial Sequence; identical to SEQ ID NO: 201954
  derived and/or modified sequence opt5 from neuraminidase__InfluenzaA__AGR49986

SEQ ID NO: 206777 - RNA, 1413 nt, Artificial Sequence; identical to SEQ ID NO: 201954
  derived and/or modified sequence opt5 from neuraminidase__InfluenzaA__AGR49998

SEQ ID NO: 206778 - RNA, 1410 nt, Artificial Sequence; identical to SEQ ID NO: 199752
  derived and/or modified sequence opt5 from neuraminidase__InfluenzaA__AGR50010

SEQ ID NO: 206779 - RNA, 1410 nt, Artificial Sequence; identical to SEQ ID NO: 199752
  derived and/or modified sequence opt5 from neuraminidase__InfluenzaA__AGR50021

SEQ ID NO: 206780 - RNA, 1410 nt, Artificial Sequence; identical to SEQ ID NO: 199762
  derived and/or modified sequence opt5 from neuraminidase__InfluenzaA__AGR50032

SEQ ID NO: 206781 - RNA, 1410 nt, Artificial Sequence
  derived and/or modified sequence opt5 from neuraminidase__InfluenzaA__AGR50043
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacauguacgguggucaugaccgauggauccgcuagcggcaaggccgacacaaaaauccucuuuaucgaggaggggaagauuguucauaccuccacacugucuggaagcgcgcaacacguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacgccccggaagaaugacagcuccucuagcucccauugccuggauccgaacaaugaagagggcgggcacggagugaaaggcugggccuucgacgaugggaacgacguuuggaugggacgcaccaucagcgaaaagucuagacucggcuaugagacauuuaaagugaucgaggggugguccaauccuaagagcaaacugcagauuaaccggcaggucaucguggaucgcggaaauagaucuggcuacuccggcauuuucagcgucgaagggaaguccuguaucaaccggugcuuuuauguggagcugauuagaggacgcaaggaagagaccgaaguucucuggaccucuaauagcaucguggucuucuguggcacauccgggaccuacggaacaggcucuuggcccgacggggcugaucugaaccuuaugccuauuuga

SEQ ID NO: 206782 - RNA, 1410 nt, Artificial Sequence; identical to SEQ ID NO: 199752
  derived and/or modified sequence opt5 from neuraminidase__InfluenzaA__AGR50055

SEQ ID NO: 206783 - RNA, 1410 nt, Artificial Sequence
  derived and/or modified sequence opt5 from neuraminidase__InfluenzaA__AGR50066
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuuaagauugaaaaaggcaagaucguuaaaagcguggagaugaacgcucccaauuaucauuacgaagagugcuccuguuacccugacucuagcgagaucacaugcgugugccgcgauaacuggcacggguccaauagacccugggucagcuucaaccagaaucuggaauaucagauuggauacaucuguucuggcauuuuuggggacaacccucggcccaaugauaagaccggauccugcggcccggugagcucuaacggggccaacggaguuaagggcuucuccuuuaaauauggcaaugggguguggaucggacgcacaaagagcauuuccucuagaaacggcuucgagaugaucugggacccuaauggguggaccggaaccgauaacaauuuuagcauuaaacaagacaucgucggcaucaacgaaugguccggguacucuggcagcuucgugcagcaucccgagcuuacaggacuggacuguauucggccuugcuucuggguugaacucauccgcggcagacccaaggagaauacgauuuggaccuccgggagcucuaucuccuuuuguggagugaacagcgauacagucggcuggucuuggcccgacggggcugagcugccuuucaccauugauaaauga

SEQ ID NO: 206784 - RNA, 1410 nt, Artificial Sequence; identical to SEQ ID NO: 199752
  derived and/or modified sequence opt5 from neuraminidase__InfluenzaA__AGR50077

SEQ ID NO: 206785 - RNA, 1410 nt, Artificial Sequence; identical to SEQ ID NO: 199752
  derived and/or modified sequence opt5 from neuraminidase__InfluenzaA__AGR50088

SEQ ID NO: 206786 - RNA, 1410 nt, Artificial Sequence; identical to SEQ ID NO: 199752
  derived and/or modified sequence opt5 from neuraminidase__InfluenzaA__AGR50099

SEQ ID NO: 206787 - RNA, 1410 nt, Artificial Sequence; identical to SEQ ID NO: 199752
  derived and/or modified sequence opt5 from neuraminidase__InfluenzaA__AGR50110

SEQ ID NO: 206788 - RNA, 1410 nt, Artificial Sequence
  derived and/or modified sequence opt5 from neuraminidase__InfluenzaA__AGR50121
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugccuagcaacggggccaacggaguuaagggcuucucuuuuaaguauggcaaugggguguggaucggaagaacaaaauccauuagcucccggaacggcuucgagaugaucugggaccccaauggguggaccggaaccgauaacaauuuuucuauuaagcaagacaucgucggcaucaacgaauggagcggguacuccggcucuuucgugcagcauccugagcuuacaggacuggacuguauucgccccugcuucuggguugaacucaucagaggccggcccaaagagaauacgauuuggaccagcggguccagcaucucuuuuuguggagugaacuccgauacagucggcuggagcuggccugacggggcugagcugccguucaccauugauaaguga

SEQ ID NO: 206789 - RNA, 1410 nt, Artificial Sequence
  derived and/or modified sequence opt5 from neuraminidase__InfluenzaA__AGR50132
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgccaacggguccuguuucaccgugaugacggauggaccgagcaauggccaggcuucuuacaaaaucuuucgcauugaaaagggcaaaaucgucaagagcguugagaugaacgcccccaauuaucauuacgaagagugcuccuguuacccugacucuagcgagaucacaugcgugugcagagauaacuggcacggguccaaucggcccugggugagcuucaaccagaaucuggaauaucagauuggauacaucuguucuggcauuuuuggggacaacccucgccccaaugauaaaaccggauccugcggcccggucagcucuaacggggcuaacggagugaagggcuucuccuuuaaguauggcaaugggguuuggaucggaagaacaaaaagcauuuccucucggaacggcuucgagaugaucugggacccuaauggguggaccggaaccgauaacaauuuuagcauuaagcaagacaucgugggcaucaacgaaugguccggguacucuggcagcuucguccagcaucccgagcuuacaggacuggacuguauucgcccuugcuucuggguggaacucaucagaggccggcccaaagagaauacgauuuggaccuccgggagcucuaucuccuuuuguggaguuaacagcgauacagugggcuggucuuggcccgacggggccgagcugccuuucaccauugauaaguga

SEQ ID NO: 206790 - RNA, 1410 nt, Artificial Sequence; identical to SEQ ID NO: 199752
  derived and/or modified sequence opt5 from neuraminidase__InfluenzaA__AGR50143

SEQ ID NO: 206791 - RNA, 1410 nt, Artificial Sequence; identical to SEQ ID NO: 199752
  derived and/or modified sequence opt5 from neuraminidase__InfluenzaA__AGR50154

SEQ ID NO: 206792 - RNA, 1413 nt, Artificial Sequence; identical to SEQ ID NO: 201954
  derived and/or modified sequence opt5 from neuraminidase__InfluenzaA__AGR50165

SEQ ID NO: 206793 - RNA, 1410 nt, Artificial Sequence; identical to SEQ ID NO: 199752
  derived and/or modified sequence opt5 from neuraminidase__InfluenzaA__AGR50177

SEQ ID NO: 206794 - RNA, 1410 nt, Artificial Sequence; identical to SEQ ID NO: 199752
  derived and/or modified sequence opt5 from neuraminidase__InfluenzaA__AGR50188

SEQ ID NO: 206795 - RNA, 1410 nt, Artificial Sequence; identical to SEQ ID NO: 199752
  derived and/or modified sequence opt5 from neuraminidase__InfluenzaA__AGR50199

SEQ ID NO: 206796 - RNA, 1410 nt, Artificial Sequence; identical to SEQ ID NO: 199752
  derived and/or modified sequence opt5 from neuraminidase__InfluenzaA__AGR50210

SEQ ID NO: 206797 - RNA, 1410 nt, Artificial Sequence; identical to SEQ ID NO: 199752
  derived and/or modified sequence opt5 from neuraminidase__InfluenzaA__AGR50221

SEQ ID NO: 206798 - RNA, 1410 nt, Artificial Sequence
  derived and/or modified sequence opt5 from neuraminidase__InfluenzaA__AGR50232
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgaauaacggccaggccagcuacaaaaucuuucgcauugaaaagggcaaaaucguuaagucuguggagaugaaugcucccaacuaucauuacgaagagugcagcuguuacccugacuccucugagaucacaugcgugugcagagauaauuggcacgggagcaaccggcccugggucuccuucaaucagaaccuggaauaucagauuggauacaucuguagcggcauuuuuggggacaauccucgccccaacgauaaaaccggaucuugcggcccgguguccagcaacggggccaauggaguuaagggcuucucuuuuaaguauggcaacgggguguggaucggaagaacaaaauccauuagcucccggaauggcuucgagaugaucugggacccuaacggguggaccggaaccgauaauaacuuuucuauuaagcaagacaucgucggcaucaaugaauggagcggguacuccggcucuuucgugcagcaucccgagcuuacaggacuggacuguauucgcccuugcuucuggguugaacucaucagaggccggcccaaagagaacacgauuuggaccagcggguccagcaucucuuuuuguggagucaauuccgauacagugggcuggagcuggcccgacggggcugagcugccuuucaccauugauaaguga

SEQ ID NO: 206799 - RNA, 1410 nt, Artificial Sequence; identical to SEQ ID NO: 199752
  derived and/or modified sequence opt5 from neuraminidase__InfluenzaA__AGR50243

SEQ ID NO: 206800 - RNA, 1410 nt, Artificial Sequence; identical to SEQ ID NO: 199752
  derived and/or modified sequence opt5 from neuraminidase__InfluenzaA__AGR50254

SEQ ID NO: 206801 - RNA, 1410 nt, Artificial Sequence; identical to SEQ ID NO: 199752
  derived and/or modified sequence opt5 from neuraminidase__InfluenzaA__AGR50265

SEQ ID NO: 206802 - RNA, 1410 nt, Artificial Sequence
  derived and/or modified sequence opt5 from neuraminidase__InfluenzaA__AGR50276
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgagcagagcguggucuccgugaaacuugcgggaaauucuagccugugcccuguuuccgggugggcuauuuacagcaaggacaacucugugagaaucggcuccaaaggggaugucuuugugauccgggaaccguucauuagcuguucuccccucgagugccgcaccuuuuuccugacacagggagcccuucugaaugacaagcauuccaacggcaccaucaaagauagaagcccuuaucggacgcucaugucuugucccauuggcgaaguuccuucccccuacaacagccgcuuugaguccguggccuggucugcuagcgccugccacgacgggaucaauuggcugaccauuggaaucuccggcccugauaacggggcugucgccgugcugaaguauaauggaaucauuacagacaccaucaagagcuggagaaacaauauucuccggacacaagagucugaaugugcgugcgugaacggcuccuguuucaccgucaugacggaugggccgagcaauggacaggccucuuacaaaaucuuucgcauugagaagggcaaaaucguuaagagcguggaaaugaacgcucccaauuaucauuacgaggagugcuccuguuacccugacucuagcgaaaucacaugcgugugcagagauaacuggcacggcuccaaucggcccugggucagcuucaaccagaaucuggaguaucagauuggguacaucuguucuggaauuuuuggcgacaacccucgccccaaugauaaaaccggguccugcggaccggugagcucuaacggcgccaacgggguuaagggauucuccuuuaaguauggcaauggcguguggaucgggagaacaaaaagcauuuccucucggaacggauucgaaaugaucugggacccuaauggcuggaccgggaccgauaacaauuuuagcauuaagcaagacaucgucggaaucaacgagugguccggcuacucugggagcuucgugcagcaucccgaacuuacaggccuggacuguauucgcccuugcuucuggguugagcucaucagaggacggcccaaagagaauacgauuuggaccuccggcagcucuaucuccuuuuguggggugaacagcgauacagucggauggucuuggcccgacggcgcugaacugccuuucaccauugauaaguga

SEQ ID NO: 206803 - RNA, 1410 nt, Artificial Sequence; identical to SEQ ID NO: 199752
  derived and/or modified sequence opt5 from neuraminidase__InfluenzaA__AGR50287

SEQ ID NO: 206804 - RNA, 1410 nt, Artificial Sequence
  derived and/or modified sequence opt5 from neuraminidase__InfluenzaA__AGR50298
augaaccccaaucagaagaucauuaccaucggcagcgugugcaugacaauugggauggccaaccugauccuccaaauuggaaauacgaucuccaucuggauuucucacagcauccagccuggcaaccagaaucagauugagaccuguaaccaauccgucaucacauacgaaaauaacaccuggguuaaucagacauaugugaacauuucuaauaccaacuucgcugccgggcagagcguggucuccgugaaacuggcgggaaauucuagccuuugcccgguuuccggcugggcuaucuacagcaaggacaacucuauuagaaucggguccaaaggagauguguuugucauccgggagcccuucauuagcuguucuccucuggaaugccgcacauuuuuccucacccagggcgcccugcuuaaugacaagcauuccaacggcacgaucaaagauagaagccccuaucggacccugaugucuuguccuauuggggaggugcccuccccuuacaacagccgcuuugaauccguugccuggucugcuagcgccugccacgacggaaucaauuggcucacaauuggcaucuccgggccggauaacggagcuguggccguccugaaguauaauggcaucauuaccgacacaaucaagagcuggagaaacaauauucugcggacccaagagucugagugugcgugcgugaacggguccuguuucacggugaugacagauggacccagcgacggccaggccucuuacaaaaucuuucgcauugaaaagggcaaaaucgucaagagcguugagaugaaugcuccuaacuaucauuacgaagagugcuccuguuaccccgauucuagcgagauuaccugcgugugcagagacaauuggcacggguccaaccggccuugggugagcuucaaucagaaccucgaauaucagaucggauacaucuguucuggcauuuuuggggauaauccccgcccgaacgacaaaacaggauccugcggcccugucagcucuaauggggccaacggagugaagggcuucuccuuuaaguauggcaacgggguuuggaucggaagaaccaaaagcauuuccucucggaauggcuucgagaugaucugggaucccaacggguggaccggaacagacaauaacuuuagcauuaagcaagacaucgugggcaucaaugaaugguccggguacucuggcagcuucguccagcauccugagcugacgggacuugauuguauucgccccugcuucuggguggaacugaucagaggccggcccaaagagaacaccauuuggacauccgggagcucuaucuccuuuuguggaguuaauagcgacaccgugggcuggucuuggccugauggggcugagcucccguucacaauugacaaguga

SEQ ID NO: 206805 - RNA, 1410 nt, Artificial Sequence; identical to SEQ ID NO: 199752
  derived and/or modified sequence opt5 from neuraminidase__InfluenzaA__AGR50309

SEQ ID NO: 206806 - RNA, 1410 nt, Artificial Sequence; identical to SEQ ID NO: 199752
  derived and/or modified sequence opt5 from neuraminidase__InfluenzaA__AGR50320

SEQ ID NO: 206807 - RNA, 1410 nt, Artificial Sequence; identical to SEQ ID NO: 199752
  derived and/or modified sequence opt5 from neuraminidase__InfluenzaA__AGR50331

SEQ ID NO: 206808 - RNA, 1410 nt, Artificial Sequence
  derived and/or modified sequence opt5 from neuraminidase__InfluenzaA__AGR50342
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcgugauuuccgucaaacuugcgggaaauucuagccugugcccuguguccggcugggcuaucuacagcaaggacaacucuguuagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaacggagugaagggcuucuccuuuaaguauggcaaugggguuuggauuggaagaacaaaaagcaucuccucucggaacggcuucgagaugauuugggacccuaauggguggaccggaaccgauaacaauuuuagcaucaagcaagacaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 206809 - RNA, 1410 nt, Artificial Sequence; identical to SEQ ID NO: 199752
  derived and/or modified sequence opt5 from neuraminidase__InfluenzaA__AGR50353

SEQ ID NO: 206810 - RNA, 1413 nt, Artificial Sequence; identical to SEQ ID NO: 201954
  derived and/or modified sequence opt5 from neuraminidase__InfluenzaA__AGR50364

SEQ ID NO: 206811 - RNA, 1410 nt, Artificial Sequence
  derived and/or modified sequence opt5 from neuraminidase__InfluenzaA__AGR55170
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaauagcaagcugcagaucaaccggcagauuaucguggaucgcggaaauagaucuggcuacuccggcauuuucagcgucgaggggaaauccuguaucaaccggugcuuuuauguggaacugauuagaggacgcaaggaggaaaccgagguccucuggaccucuaauagcaucgugguuuucuguggcacauccgggaccuacggaacaggcucuuggcccgacggggcugauaucaaccugaugccuauuuga

SEQ ID NO: 206812 - RNA, 1410 nt, Artificial Sequence; identical to SEQ ID NO: 197169
  derived and/or modified sequence opt5 from neuraminidase__InfluenzaA__AGR55180

SEQ ID NO: 206813 - RNA, 1410 nt, Artificial Sequence; identical to SEQ ID NO: 197169
  derived and/or modified sequence opt5 from neuraminidase__InfluenzaA__AGR55181

SEQ ID NO: 206814 - RNA, 1410 nt, Artificial Sequence; identical to SEQ ID NO: 197169
  derived and/or modified sequence opt5 from neuraminidase__InfluenzaA__AGR55183

SEQ ID NO: 206815 - RNA, 1410 nt, Artificial Sequence
  derived and/or modified sequence opt5 from neuraminidase__InfluenzaA__AGR55184
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaagaaucaggugaugcugugcgaacccacaaucauugagagaaacaucaccgaaauuguguaccucacaaauaccacgaucgagaaagaaauuuguccuaagcuggccgaguaucggaacuggagcaaaccccagugcaauaucaccggguucgcgccuuuuuccaaggacaacucuauucgccuuagcgcuggaggcgauaucugggucacaagagagcccuacguguccugugacccugauaagugcuaucaauucgcccuggggcagggaaccacacucaauaacggccacucuaaugacaccguucaugaucggacgccguaccgcacacugcugaugaacgaacucggggugcccuuucaccugggaaccagacaggucuguaucgccuggagcuccagcucuugccaugacggcaaggcuuggcuucacguguguguuacaggcgaugacaaaaaugccaccgcuuccuucauuuauaacgggcggcugguggauagcaucggaucuugguccaaaaagauucuccgcacccaggagagcgaaugcgucuguaucaauggcacaugcacgguggugaugaccgacgggucugccuccggaaaagcggauacaaagauucuguuuaucgaggagggcaagaucguccacauuagcacccuuuccgggucugcccaacauguugaagagugcagcuguuacccuagauaucccggagugcggugcgugugucgcgacaacuggaaaggcuccaacagaccuaucgucgauauuaaugugaaggacuacagcaucguuucuuccuacgugugcagcggccuggucggggacacaccccggaaaaacgauucuuucagcuccucucacugucucgacccgaauaacgaagagggaggccauggggugaagggaugggcuuuugaugacggcaaugauguuuggauggggcgcaccauuagcgaaaaacugagauccggauaugagacguucaaggugaucgagggcuggagcaaaccuaacucuaagcugcagaucaaucggcaggucauuguggaacgcggcaacagauccggguacagcggaaucuuuucugucgagggcaaguccugcauuaaucgguguuucuauguggaacucaucagagggcgcaaagaggaaacagagguuugguggaccagcaacuccauuguggucuuuugcggaaccucuggcacauacgggaccggcagcuggcccgacggagccgauaucaaucugaugccuauuuga

SEQ ID NO: 206816 - RNA, 1410 nt, Artificial Sequence
  derived and/or modified sequence opt5 from neuraminidase__InfluenzaA__AGR55185
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaagaaucaggugaugcugugcgaacccacaaucauugagagaaacaucaccgaaauuguguaccucacaaauaccacgaucgagaaagaaauuuguccuaagcuggccgaguaucggaacuggagcaaaccccagugcaauaucaccggguucgcgccuuuuuccaaggacaacucuauucgccuuagcgcuggaggcgauaucugggucacaagagagcccuacguguccugugacccugauaagugcuaucaauucgcccuggggcagggaaccacacucaauaacggccacucuaaugacaccguucaugaucggacgccguaccgcacacugcugaugaacgaacucggggugcccuuucaccugggaaccagacaggucuguaucgccuggagcuccagcucuugccaugacggcaaggcuuggcuucacguguguguuacaggcgaugacaaaaaugccaccgcuuccuucauuuauaacgggcggcugguggauagcaucggaucuugguccaaaaagauucuccgcacccaggagagcgaaugcgucuguaucaauggcacaugcacgguggugaugaccgacgggucugccuccggaaaagcggauacaaagauucuguuuaucgaggagggcaagaucguccacauuagcacccuuuccgggucugcccaacauguugaagagugcagcuguuacccuagauaucccggagugcggugcgugugucgcgacaacuggaaaggcuccaacagaccuaucgucgauauuaaugugaaggacuacagcaucguuucuuccuacgugugcagcggccuggucggggacacaccccggaaaaacgauucuuucagcuccucucacugucucgacccgaauaacgaagagggaggccauggggugaagggaugggcuuuugaugacggcaaugauguuuggauggggcgcaccauuagcgaaaaacugagauccggauaugagacguucaaggugaucgagggcuggagcaaaccuaacucuaagcugcagaucaaucggcaggucauuguggaacgcggcaacagauccggguacagcggaaucuuuucugucgagggcaaguccugcauuaaucgguguuucuauguggaacucaucagagggcgcaaagaggaaacagagguuugguggaccagcaacuccauuguggucuuuugcggaaccucucggacauacggcaccgggagcuggcccgacggcgccgauaucaaucugaugccuauuuga

SEQ ID NO: 206817 - RNA, 1410 nt, Artificial Sequence
  derived and/or modified sequence opt5 from neuraminidase__InfluenzaA__AGR55186
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggaaccgaauaacgaggaaggcgggcacggagugaaaggcugggccuucgaugacgggaaugauguuuggaugggacggacgaucagcgagaaacuccgcucuggcuacgagacauuuaaggugaucgaagggugguccaacccuaauagcaaacugcagauuaacagacaggucaucguggaccggggaaaucgcucuggcuauuccggcauuuucagcgucgaggggaaguccuguaucaacagaugcuuuuacguggaacugauucggggaagaaagcaggagaccgaaguucucuggaccucuaauagcaucguggucuucuguggcacauccgggaccuauggaacaggcucuuggcccgauggggcugacauuaaccugaugccuaucuga

SEQ ID NO: 206818 - RNA, 1410 nt, Artificial Sequence; identical to SEQ ID NO: 197169
  derived and/or modified sequence opt5 from neuraminidase__InfluenzaA__AGR55187

SEQ ID NO: 206819 - RNA, 1410 nt, Artificial Sequence; identical to SEQ ID NO: 197738
  derived and/or modified sequence opt5 from neuraminidase__InfluenzaA__AGR55192

SEQ ID NO: 206820 - RNA, 1410 nt, Artificial Sequence
  derived and/or modified sequence opt5 from neuraminidase__InfluenzaA__AGR55195
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggaucauuggaaggggagcaaccgcccuaucguggacauuaacaucaaagacuacucuauuguuuccagcuauguguguucuggacuugucggcgauacccccagaaagaaugacagcuccucuagcucccacugccuggauccgaacaaugaggaaggcgggcauggagugaaaggcugggccuucgacgaugggaacgacguuuggaugggacggacgaucagcgagaagcuccgccugggcuacgagacauuuaaagugaucgaaggguggucuaauccuaacuccaagcugcagauuaauagacaggucaucguggaucggggaaaccgcagcggcuauucuggcauuuucuccgucgaggggaaaagcuguaucaauagaugcuuuuacguggaacucauucggggaagaaaggaggaaaccgagguucuguggaccuccaacucuaucguggucuucuguggcacaagcgggaccuauggaacaggcuccuggcccgacggggcugauauuaaucuuaugccuaucuga

SEQ ID NO: 206821 - RNA, 1410 nt, Artificial Sequence
  derived and/or modified sequence opt5 from neuraminidase__InfluenzaA__AGR55204
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcgaggccgacacaaagauccucuuuauugaagaggggaaaaucguccauaccuccacacugucuggaagcgcgcaacacguugaagagugcuccugcuauccuagauaccccggcgugcggugugugugccgcgauaacuggaaggggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgagaaaucuagacucggcuaugaaacauuuaagguuauugaggggugguccaacccuaaaagcaagcugcagaucaaucgccaggugauugucgaucggggaaacagaucuggcuacuccggcaucuucagcguggaagggaaauccuguauuaaucggugcuuuuaugucgagcugaucagaggacgcaaggaagagaccgaggugcucuggaccucuaacagcauuguuguguucuguggcacaucccggaccuacgggacaggaucuuggcccgacggcgcugauaucaaucugaugccuaucuga

SEQ ID NO: 206822 - RNA, 1410 nt, Artificial Sequence
  derived and/or modified sequence opt5 from neuraminidase__InfluenzaA__AGR55218
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcauugccugguccucuagcuccugucaugacggaaaggccuggcugcacguuugcaucacaggcgaugacaagaacgcuaccgccagcuucauuuacaauggccggcuuguggauucuaucgucuccuggagcaaagagauucugcgcacccaggaaucugagugugugugcaucaacgggacauguacgguggucaugaccgacggauccgcuagcggcaaggccgauacaaaaauccucuuuauugaggaagggaagaucguucauaccuccacacugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugauugaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaaccgagguucucuggaccucuaauagcauuguggucuucuguggcacauccgggaccuacggaacaggcucuuggcccgauggggcugacaucaaccugaugccuaucuga

SEQ ID NO: 206823 - RNA, 1410 nt, Artificial Sequence; identical to SEQ ID NO: 206413
  derived and/or modified sequence opt5 from neuraminidase__InfluenzaA__AGT18726

SEQ ID NO: 206824 - RNA, 1410 nt, Artificial Sequence
  derived and/or modified sequence opt5 from neuraminidase__InfluenzaA__AGT18727
augaaccccaaucagaagaucauuaccaucggcagcgugugcaugacaauugggauggccaaccugauccuccaaauuggaaauaucaucuccauuuggaucucucacagcauucagcugggcucccagaaccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagaugaaugcucccaacuaucauuacgaagagugcagcuguuacccugauuccagcgagauuacaugcgugugcagagacaauuggcacgggucuaaccggcccuggguguccuucaaucagaaccuggaauaucagaucggauacauuuguagcggcaucuuuggggauaauccucgccccaacgacaaaaccggaucuugcggcccggucuccagcaauggggccaacggagugaagggcuucuccuuuaaguauggcaaugggguuuggauuggaagaacaaaaucuaucagcucccggaagggcuucgagaugauuugggauccuaacggguggucuggaaccgacaacaauuuuagcaucaaacaagacaucgugggcauuaacgaaugguccggguacagcggcucuuucguccagcaucccgagcuuaccggacuggauuguauccgcccuugcuucuggguggaacucauuagaggccggcccaaggagaauacaaucuggacguccgggagcucuauuuccuuuuguggaguuaacagcgacaccgugggcuggucuuggcccgauggggcugagcugccuuucacaaucgacaaauga

SEQ ID NO: 206825 - RNA, 1410 nt, Artificial Sequence; identical to SEQ ID NO: 206413
  derived and/or modified sequence opt5 from neuraminidase__InfluenzaA__AGT18728

SEQ ID NO: 206826 - RNA, 1410 nt, Artificial Sequence
  derived and/or modified sequence opt5 from neuraminidase__InfluenzaA__AGT18729
augaaccccaaucagaagaucauuaccaucggccaagugugcaugacaauugggauggccaaccugauccuccagauuggaaauaucaucagcauuuggaucucccacucuauucagcugggcagccagaaccaaaucgagacguguaaucaguccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucugugagaaucggguccaaaggagaugucuuugugauccgggagccguucauuagcuguucuccccucgaaugccgcaccuuuuuccugacacaaggcgcccuucugaacgacaagcauuccaauggcaccaucaaagauagaagcccuuaucggacgcucaugucuugucccauuggggagguuccuucccccuacaacagccgcuuugaauccguggccuggucugcuagcgccugccacgacggaaucaacuggcugaccauuggcaucuccgggccugauagcggagcugucgccgugcugaaguauaauggcaucauuacagacaccaucaagucuuggagaaacaauauucuccggacacaggaguccgagugugcgugcgugaacgggagcuguuucaccaucaugacggauggaccgucugacggccaggccagcuacaaaauuuuucgcaucgaaaagggcaaaaucgucaaguccguugagaugaaugcucccaacuaucauuacgaagagugcucuuguuacccugauagcuccgagauuacaugcgugugcagagacaauuggcacgggagcaaccggcccugggugucuuucaaucagaaccuggaauaucaaaucggauacauuuguuccggcaucuuuggggauaauccucgccccaacgacaaaaccggaagcugcggcccggucucuuccaauggggccaacggagugaagggcuucagcuuuaaguauggcaaugggguuuggauuggaagaacaaaauccaucucuagccggaagggcuucgagaugauuugggauccuaacggguggaccggaaccgacaacaauuuuuccaucaaacaggacaucgugggcauuaacgaauggucuggguacagcggcuccuucguccagcaucccgagcuuacaggacuggauuguauccgcccuugcuucuggguggaacucauuagaggccggcccaaggagaauacgaucuggaccagcgggucuuccauuagcuuuuguggaguuaacucugacacagugggcugguccuggcccgauggggcugagcugccuuucaccaucgacaaauga

SEQ ID NO: 206827 - RNA, 1410 nt, Artificial Sequence
  derived and/or modified sequence opt5 from neuraminidase__InfluenzaA__AGT18730
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagauuaaugcucccaacuaucauuacgaagagugcagcuguuacccugauuccagcgagaucacaugcgugugcagagacaauuggcacgggucuaaccggcccuggguguccuucaaucagaaccuggaauaucagauuggauacaucuguagcggcauuuuuggggauaauccucgccccaacgacaaaaccggaucuugcggcccggucuccagcaauggggccaacggagugaagggcuucuccuuuaaguauggcaaugggguuuggaucggaagaacaaaaucuauuagcucccggaagggcuucgagaugaucugggauccuaacggguggaccggaaccgacaacaauuuuucuaucaaacaagacauugugggcaucaacgaauggagcggguacuccggcagcuucguccagcaucccgagcuuacaggacuggauuguauucgcccuugcuucuggguggaacucaucagaggccggcccaaggagaauacgauuuggaccucuggguccagcaucucuuuuuguggaguuaacuccgacacagugggcuggagcuggcccgauggggcugagcugccuuucaccaucgacaaauga

SEQ ID NO: 206828 - RNA, 1410 nt, Artificial Sequence; identical to SEQ ID NO: 206413
  derived and/or modified sequence opt5 from neuraminidase__InfluenzaA__AGT18731

SEQ ID NO: 206829 - RNA, 1410 nt, Artificial Sequence
  derived and/or modified sequence opt5 from neuraminidase__InfluenzaA__AGT18732
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagaugaaugcucccaacuaucauuacgaagagugcagcuguuacccugauuccagcgagauuacaugcgugugcagagacaauuggcacgggucuaaccggcccuggguguccuucaaucagaaccuggaauaucagaucggauacauuuguagcggcaucuuuggggauaauccucgccccaacgacaaaaccggaucuugcggcccggucuccagcaauggggccaacggagugaagggcuucuccuuuaaguauggcaaugggguuuggauuggaagaacaaaaucuaucagcucccggaagggcuucgagaugauuugggauccuaacggguggaccggaaccgacaacaauuuuucuaucaaacaagacaucgugggcauuaacgaauggagcggguacuccggcagcuucguccagcaucccgagcuuacaggacuggauuguauccgcccuugcuucuggguggaacucauuagaggccggcccaaggagaauacgaucuggacccgcgggucuuccauuagcuuuuguggaguuaacucugacacagugggcugguccuggcccgauggggcugagcugccuuucaccaucgacaaauga

SEQ ID NO: 206830 - RNA, 1410 nt, Artificial Sequence
  derived and/or modified sequence opt5 from neuraminidase__InfluenzaA__AGT18733
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauucuggagcugucgccgugcugaaguauaauggcaucauuacagacaccaucaaguccuggagaaacaauauucuccggacacaagagagcgagugugcgugcgugaacgggucuuguuucaccaucaugacggauggaccgagcgacggccaggccuccuacaaaauuuuucgcaucgaaaagggcaaaaucgucaagucuguugagaugaaugcucccaacuaucauuacgaagagugcagcuguuacccugauuccagcgagucuacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcuccaauggggccaacggagugaagggcuucucuuuuaaguauggcaaugggguuuggaucggaagaacaaaaagcauuuccucucggaagggcuucgagaugaucugggauccuaacggguggaccggaaccgacaacaauuuuagcauuaaacaagacaucgugggcaucaacgaaugguccggguacagcggcucuuucguccagcaucccgagcuuacaggacuggauuguauucgcccuugcuucuggguggaacucaucagaggccggcccaaggagaauacgauuuggaccuccgggagcucucgcuccuuuuguggaguuaacagcgacacagugggcuggucuuggcccgauggggcugagcugccuuucaccaucgacaaauga

SEQ ID NO: 206831 - RNA, 1410 nt, Artificial Sequence
  derived and/or modified sequence opt5 from neuraminidase__InfluenzaA__AGT18762
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuacacuuugugaacccauuaucauugagagaaauaucaccgaaauuguguaucugacaaacaccacgaucgagaaggaaauuugcccuaaacccgcugaguaccggaauugguccaagccucagugugggaucaccggauucgcccccuuuucuaaagacaacagcauccgccucuccgcgggcggggauauuugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcaucgccugguccucuagcuccugucaugauggcaaagccuggcuccacgugugcauuacaggcgacgauaagaacgcuaccgccagcuucaucuacaaugggcggcugguugacucuguggucuccuggagcaaagagauucuucgcacccaggaaucugagugugugugcaucaacggaacauguacgguggucaugaccgauggcuccgcuagcgggaaggccgacacaaaaauccuguuuauugaggaaggaaagaucguucauaccuccacacucucuggcagcgcgcaacacguggaggaaugcuccugcuaucccagauacccuggggugcggugugucugccgcgauaacuggaagggaagcaauagacccauuguggacaucaacauuaaagaucacucuaucguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugauugaaggauggucuaaccccaaauccaagcuccagaucaaucggcaggucauuguggaucgcggcgacagaagcggcuacucugggaucuucuccgucgagggaaaaagcuguauuaaccggugcuuuuauguggaacugaucagaggccgcaaggaggaaaccgagguucuguggacauccaauucuauuguggucuucugugggaccagcggaacauacggcacgggguccuggccugauggcgcugaccucaaccugaugcccaucuga

SEQ ID NO: 206832 - RNA, 1410 nt, Artificial Sequence
  derived and/or modified sequence opt5 from neuraminidase__InfluenzaA__AGT18764
augaaccccaaucagaugaucauuaccaucggcagcgugucccugacaucuagcacgauuugcuucuuuaugcaaaccgccuccuucaucacaaccgucacacuccacauuaagcagcaugaguuucacucuccuccgaacaaucagguuaugcugugugaacccaccaucaucgagagaaacauuacagaaaucguguaccuuaccaauacgaccauugagaaagaaaucugcccuaagcuggcugaguaucggaacuggagcaaaccccagugugacauuacaggguucgccccuuuuuccaaggauaauucuauccgccucagcgcgggaggcgacauuugggugaccagagagcccuacgucuccugcgauccugacaaauguuaucaauucgcucuggggcagggaacaacccuuaacaaugugcauagcaacaauacgguucgggaucgcacaccguacagaacccugcucaugaacgaacugggcgugcccuuucaccuggggacaaagcaggucugcaucgccuggucuuccagcucuugucaugacggaaaggccuggcuccacgugugcaucaccggcgaugacaaaaaugcuaccgccuccuucauuuauaacggcaagcugguugauagcguggucucuugguccaaagagauccuucggacacaggaaagcgagugugugugcauuaaugggacguguaccguggucaugacagacggauccgcuucuggcaaggccgauaccaaaauccuguuuauugaggaagggaagaucguucacacaagcacccucuccggaagcgcgcaacauguggaggaaugcucuugcuacccucgcuaucccggcgugagaugugucugccgggacaacuggaagggguccaaccgcccuaucguggauauuaauaugaaagaccacagcaucguuucuagcuacguguguuccggacuggucggcgacacgcccagaaagaacgaucggucuagcaauucccauugccuugacccgaacaaugaggaaggcgggcacggagugaaaggcugggccuucgaugacgggaacgauguuuggaugggacgcacaauuaaugagaccagcagacugggcuacgagaccuuuaaggugaucgaaggguggucuaacccuaaauccaagcuccagauuaaucggcaggucaucguggaccgcggaaacagaagcggcuauucuggcaucuucuccgucgaggggaaaagcuguauuaaucggugcuuuuacguggaacugaucagaggacgcaaggaggaaacagagguucuguggaccuccaacucuauuguggucuucuguggcacaagcgggacguauggaaccggcuccuggcccgauggggcugaccucaaucugaugccuaucuga

SEQ ID NO: 206833 - RNA, 1410 nt, Artificial Sequence
  derived and/or modified sequence opt5 from neuraminidase__InfluenzaA__AGT18765
augaaccccaaucagaagaucauuaccaucggcagcgugucccugacaauuucuacgaucugcuucuuuaugcaaauugccauccucaucaccacagucacccugcacuucaaacagcaugaguuucacagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccucuagcuccugucaugacggaaaagccuggcugcacgugugcaucacaggcgaugacaagaaugcuaccgccagcuucauuuauaacggccggcuuguugauucuguggucuccuggagcaaagagauccugcgcacccaggaaucugagugugugugcauuaaugggacauguacgguggucaugaccgacggauccgcuagcggcaaggccgauacaaaaauccucuuuaucgaggaagggaagauuguucacaccuccacacugucuggaagcgcgcaacauguggaggaaugcuccugcuacccuagauaucccggcgugcggugugucugccgcgacaacuggaaggggagcaacagaccuaucguggauauuaauaugaaagaccacucuaucguuuccagcuacguguguucuggacuugucggcgacacgccccggaagaacgaucgcagcuccaauucucauugccuggacccgaacaaugaggaaggcgggcacggagugaaaggcugggccuucgaugacgggaacgauguuuggaugggaagaaccauuaaugagacaagccggcucggcuacgagaccuuuaaggugaucgaagggugguccaacccuaaaagcaagcugcagaucaaucgccaggucauuguggacagaggaaaccggucuggcuauuccggcaucuucagcgucgaggggaaaucuuguauuaauagaugcuuuuacguggaacugauccgcggacggaaggaggaaaccgagguucucuggacauccaacagcauuguggucuucuguggcaccuccgggacauauggaacgggcucuuggcccgauggggcugaccugaaucuuaugccuaucuga

SEQ ID NO: 206834 - RNA, 1410 nt, Artificial Sequence
  derived and/or modified sequence opt5 from neuraminidase__InfluenzaA__AGT18766
augaaccccaaucagaagaucauuaccaucggcagcgugucccugacaauuucuacgaucugccucuucaugcaaauugccauccugaucaccacagucacccuucacuuuaaacagcaugaguuccacagcccuccgaacaaucagguuaugcugugugaacccacaauuaucgagagaaacauuaccgaaaucguguaccucacaaauaccacgauugagaaggaaaucugcccuaaacuggcugaguaucggaacugguccaagccccagugugacauuaccggguuugccccuuucucuaaagauaauagcauccgccuuuccgcgggaggcgacaucugggugacaagagagcccuacgucucuugcgauccugacaaguguuaucaauuugcucuggggcagggaaccacacucaacaaugugcauagcaacaauaccguucgggaucgcacgccguacagaacacugcugaugaacgaacucggcgugcccuuccaccuggggaccaagcaggucugcauugccugguccucuagcuccugucaugacggaaaagccuggcuucacgugugcaucacaggcgaugacaagaaugcuaccgccagcuuuauuuauaacggccggcugguugauucuguggucuccuggagcaaagagauccuccgcacccaggaaucugagugugugugcauuaaugggacauguacgguggucaugaccgacggauccgcuagcggcaaggccgauacaaaaauccuguucaucgaggaagggaagauuguucacaccuccacacuuucuggaagcgcgcaacauguggaggaaugcuccugcuacccuagauaucccggcgugcggugugucugccgcgacaacuggaaggggagcaacagaccuaucguggauauuaauaugaaagaccacucuaucguuuccagcuacguguguucuggacuggucggcgacacgccccggaagaacgaucgcagcuccaauucucauugccucgacccgaacaaugaggaaggcgggcacggagugaaaggcugggccuuugaugacgggaacgauguuuggaugggaagaaccauuaaugagacaagccggcugggcuacgagaccuucaaggugaucgaagggugguccaacccuaaaagcaagcugcagaucaaucgccaggucauuguggacagaggaaaccggucuggcuauuccggcaucuuuagcgucgaggggaaaucuuguauuaauagaugcuucuacguggaacucauccgcggacggaaggaggaaaccgagguucuguggacauccaacagcauuguggucuuuuguggcaccuccgggacauauggaacgggcucuuggcccgauggggcugaccuuaaucugaagccuaucuga

SEQ ID NO: 206835 - RNA, 1410 nt, Artificial Sequence
  derived and/or modified sequence opt5 from neuraminidase__InfluenzaA__AGT18767
augaaccccaaucagaagaucauuaccaucggcagcgugucccugacaauuucuacgaucugcuucuuuaugcaaaccgccagccucauuacaaccgucacacugcacuucaaacagcaugaguuucacuccccuccgaacaaucagguuaugcuuugugaacccaccaucaucgagagaaacauuacagaaaucguguaccugaccaauacgaccauugagaaggaaaucugcccuaaacucgcugaguaucggaacuggucuaagccccagugugacauuacaggguucgccccuuuuagcaaagauaauuccauccgccugucugcgggaggcgacauuugggugaccagagagcccuacgucagcugcgauccugacaaguguuaucaauucgcucuugggcagggaacaacccugaacaaugugcauuccaacaauacgguucgggaucgcacaccguacagaacccuccugaugaacgaacugggcgugcccuuucaccucgggacaaagcaggucugcaucgccuggucuagcuccagcugucaugacggaaaagccuggcugcacgugugcaucaccggcgaugacaagaaugcuaccgccucuuucauuuauaacggccggcuuguugauuccguggucagcuggucuaaagagauccugcgcacacaggaauccgagugugugugcauuaaugggacguguaccguggucaugacagacggaagcgcuuccggcaaggccgauaccaaaauccucuuuauugaggaagggaagaucguucacacaucuacccugagcggauccgcgcaacauguggaggaaugcagcugcuacccuagauaucccggcgugcggugugucugccgcgacaacuggaaggggucuaacagaccuaucguggauauuaauaugaaagaccacuccaucguuagcucuuacguguguagcggacuugucggcgacacgccccggaagaacgaucgcuccucuaauagccauugccuggacccgaacaaugaggaaggcgggcacggagugaaaggcugggccuucgaugacgggaacgauguuuggaugggaagaacaauuaaugagaccucccggcucggcuacgagaccuuuaaggugaucgaaggguggagcaacccuaaaucuaagcugcagauuaaucgccaggucaucguggacagaggaaaccgguccggcuauagcggcaucuucucugucgaggggaaauccuguauuaauagaugcuuuuacguggaacugauccgcggacggaaggaggaaacagagguucucuggaccagcaacuccauuguggucuucuguggcacaucugggacguauggaaccggcagcuggcccgauggggcugaccugaaucuuaugccuaucuga

SEQ ID NO: 206836 - RNA, 1410 nt, Artificial Sequence
  derived and/or modified sequence opt5 from neuraminidase__InfluenzaA__AGT18768
augaaccccaaucagaagaucauuaccaucggcagcgugucccugacaauuucuacgaucugcuucuuuaugcaaaccgccagcuucauuacaaccgucacacuccacuuuaaacaguacgaguucaacuccccuccgaauaaccagguuaugcugugugaacccaccaucaucgagagaaauauuacagaaaucguguaucuuaccaacacgaccauugagaaggaaaucugcccuaaacuggcugaguaccggaauuggucuaagccccagugugacauuacaggguuugccccuuucagcaaagauaacuccauccgccucucugcgggaggcgacauuugggugaccagagagcccuaugucagcugcgauccugacaaguguuaccaauuugcucuggggcagggaacaacccuuaauaacgugcauuccaauaacacgguucgggaucgcacaccguauagaacccugcucaugaaugaacugggcgugcccuuccaccuggggacaaagcaggucugcaucgccuggucuagcuccagcugucaugacggaaaagccuggcuccacgugugcaucaccggcgaugacaagaacgcuaccgccucuuuuauuuacaauggccggcugguugauuccguggucagcuggucuaaagagauccuucgcacacaggaauccgagugugugugcauuaacgggacguguaccguggucaugacagacggaagcgcuuccggcaaggccgauaccaaaauccuguucauugaggaagggaagaucguucauacaucuacccucagcggauccgcgcaacacguggaggaaugcagcugcuauccuagauaccccggcgugcggugugucugccgcgacaacuggaaggggucuaauagaccuaucguggauauuaacaugaaagaccacuccaucguuagcucuuacguguguagcggacuggucggcgacacgccccggaagaaugaucgcuccucuaacagccauugccuugacccgaauaacgaggaaggcgggcacggagugaaaggcugggccuuugaugacgggaaugauguuuggaugggaagaacaauuaacgagaccucccggcugggcuaugagaccuucaaggugaucgaaggguggagcaauccuaaaucuaagcuccagauuaaccgccaggucaucguggacagaggaaaucgguccggcuacagcggcaucuuuucugucgaggggaaauccuguauuaacagaugcuucuauguggaacugauccgcggacggaaggaggaaacagagguucuguggaccagcaauuccauuguggucuucuguggcacaucugggacguacggaaccggcagcuggcccgauggggcugaccucaaccugaugccuaucuga

SEQ ID NO: 206837 - RNA, 1410 nt, Artificial Sequence; identical to SEQ ID NO: 205170
  derived and/or modified sequence opt5 from neuraminidase__InfluenzaA__AGT18769

SEQ ID NO: 206838 - RNA, 1410 nt, Artificial Sequence
  derived and/or modified sequence opt5 from neuraminidase__InfluenzaA__AGT18770
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaacaagguuaugcuuugugaacccacaauuaucgagagaaauauuaccgaaaucguguaucugacaaacaccacgauugagaaagaaaucugcccuaagcccgcugaguaccggaauugguccaaaccucagugugggauuaccggauucgcccccuuuucuaaggacaacagcauccgccucuccgcgggcggggauaucugggugacaagagagccuuaugucucuugcgacccggauaaguguuaccaguucgcucugggacaaggcaccacacuuaauaacgugcauagcaauaacaccguucgggaccgcacgcccuauagaacacugcucaugaaugaacugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggcggcugguugacucuguggucuccuggagcaaggagauccuucgcacccaggaaucugagugugugugcauuaacggaacauguacgguggucaugaccgauggcuccgcuagcgggaaagccgacacaaagauccuguuuaucgaggaaggaaagauuguucauaccuccacacucucuggcagcgcgcagcacguggaggaaugcuccugcuaucccagauacccuggggugcggugugucugccgcgauaacuggaaaggaagcaauagacccaucguggacauuaacaucaaggaucacucuauuguuuccagcuacguguguucuggccuggucggcgacaccccgcggaaaaaugacagcuccucuagcucccauugccuugauccuaacaaugaggaagggggacacggcgugaaggggugggccuucgacgauggaaacgacguuuggaugggccgcacgaucaaugagacaagcagacugggguaugagaccuuuaaagugaucgaaggauggucuaaccccaaguccaaacuccaaauuaaucggcaggucaucguggaucgcggcgacagaagcggcuacucugggauuuucuccgucgagggaaagagcuguaucaaccggugcuuuuauguggaacugauuagaggccgcaaggaggaaaccgagguucuguggacauccaauucuaucguggucuucugugggaccagcggaacauacggcacgggguccuggccugauggcgcugaccucaaccugaugcccauuuga

SEQ ID NO: 206839 - RNA, 1410 nt, Artificial Sequence
  derived and/or modified sequence opt5 from neuraminidase__InfluenzaA__AGT18771
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcccgcugaauaccggaauugguccaaaccucagugugggauuaccggauucgcccccuuuucuaaggacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugagcugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggcggcugguugacucuguggucuccuggagcaaggaaauccuucgcacccaggagucugaaugugugugcauuaacggaacauguacgguggucaugaccgauggcuccgcuagcgggaaagccgacacaaagauccuguuuaucgaggagggaaagauuguucauaccuccacacucucuggcagcgcgcaacacguggaagagugcuccugcuaucccagauacccuggggugcggugugucugccgcgauaacuggaaaggaagcaauagacccaucguggacauuaacaucaaggaucacucuauuguuuccagcuacguguguucuggccuggucggcgacaccccgcggaaaaaugacagcuccucuagcucccauugccuugauccuaacaaugaagaagggggacacggcgugaaggggugggccuucgacgauggaaacgacguuuggaugggccgcacgaucaaugagacaagcagacugggguaugagaccuuuaaagugaucgagggauggucuaaccccaaguccaaacuccagauuaaucggcaggucaucguggaucgcggcgacagaagcggcuacucugggauuuucuccgucgaaggaaagagcuguaucaaccggugcuuuuauguggagcugauuagaggccgcaaggaagagaccgaaguucuguggacauccaauucuaucguggucuucugugggaccagcggaacauacggcacgggguccuggccugauggcgcugaccucaaccugaugcccauuuga

SEQ ID NO: 206840 - RNA, 1410 nt, Artificial Sequence; identical to SEQ ID NO: 205170
  derived and/or modified sequence opt5 from neuraminidase__InfluenzaA__AGT18772

SEQ ID NO: 206841 - RNA, 1410 nt, Artificial Sequence
  derived and/or modified sequence opt5 from neuraminidase__InfluenzaA__AGT37104
augaaccccaaucagaagaucauuaccaucggcagcgugucccugacaauugccacgaucugccuccugaugcaaauugcuauccuugucaccacaguuacccugcacuucaaacaguacgaguguucuagcccuccgaacaaucaggugaugcccugcgaaccuacaaucauugagagaaacaucaccaagauuguguaucucacaaauaccacgaucgaacgggaggccugucccgaacuggcggaguaccgccauugguccaaaccucagugcaagauuagaggguuugcucccuucucuaaagacaacagcauccggcuuuccgccggaggcgauauuugggucacccgcgagccuuaugugucuugugacccggggaagugcuaccaauuugcccugggacagggcacaacccucaauaacagacacagcaaugauacaguucaugaccggacccccuaucgcacgcugcugaugaacgaacucggggugccuuuccaccugggaacaaagcaggucuguaucgcuugguccuccucuuccugccaugauggcaaagccuggcuucacguguguaucaccggccacgacaagaaugcuacagccagcuuuauuuacgaugggagacugguugacucuaucggauccuggagccagaacauucuccggacccaagagucugaaugcguguguaucaaugggaccugcacagucgugaugacggauggcuccgcgagcggacgcgccgacaccaaaauuauguucguggaggagggcaagaucguccauaucagcccccuggcugggucugcccagcacguugaagagugcagcuguuauccuaaauaccccggagugagaugcgugugucgggauaacuggaagggcuccaaucgcccgauugucgacaucaacaugaaggauuacagcauugugucuuccuauguuugcagcggccuugugggggacacaccuagacggaacgacucuagcuccaccucuuacugucugaaucccaacaaugaagagggaggccauggggucaaaggaugggcuuuugaugacggcgaugacguguggauggggcgcacaaucagcgaaaagcucagacugggauaugagaccuucaaaguuauuggcggcugguccaagccuaacagcaaacugcagaucaauagacagguggucguggauaucucuaaccgguccggguacagcggaaucuuuucugucgagggcaaguccugcauuaaucgcuguuucuauguggaacucauucgggggagaaaacaagagaacgaaguuugguggacgagcaauuccaucguggucuuuugcggaacaucuggcaccuacgggaccggcagcuggcccgacggagccgauauuaaccugaugcccaucuga

SEQ ID NO: 206842 - RNA, 1410 nt, Artificial Sequence
  derived and/or modified sequence opt5 from neuraminidase__InfluenzaA__AGU69973
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaggcuuggcuucauguguguguuacaggcgaugacgagaacgccaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugagaagcggccuggucggggacacaccgcggaagaaugauucuagcuccucuagccauugccucgacccuaacaaugaggaaggaggccacggggugaaaggaugggcuuucgaugacggcaacgauguuuggauggggcgcaccaucuccgagaaaagcagaucuggauacgagacguuuaaagugauugaaggcugguccaagcccaauagcaaacugcagaucaaccggcaggucaucguggaccgcggcaauagaucuggguauuccggaauuuucagcgucgagggcaaguccuguaucaaccggugcuuuuacguggaacugauuagagggggaaagcaggagacagaaguucucuggaccucuaauagcaucguggucuucuguggcaccuccgggacauauggcaccggaucuuggccugauggcgccgaccugaaccuuaugcccauuuga

SEQ ID NO: 206843 - RNA, 1410 nt, Artificial Sequence
  derived and/or modified sequence opt5 from neuraminidase__InfluenzaA__AGU92648
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuaucauuacgaagagugcucuuguuacccugauagcuccgagaucauuugcguuugccgggacaacuggcacggcagcaaucgccccugggugucuuucaaccagaaucuggaauaucagaucggguacauuuguuccggaaucuuuggcgauaacccuagacccaaugacaaaacagggagcugcggaccggugucuuccaacggcgccaauggggucaagggauucagcuuuaaguauggcaacggcguguggauugggcggaccaaauccaucucuagccgcaagggauucgagaugaucugggauccuaacggcuggacagggaccgacaauaacuuuuccauuaaacaagacaucguuggaauuaaugaauggucuggcuacagcggguccuucgugcagcaucccgagcuuaccggccuggauuguaucagaccuugcuucugggucgaacucauucggggacgccccaaggagaacacaaucuggacgagcggcuccuccaucagcuuuugugggguuaauucugacaccgugggaugguccuggcccgauggcgcugagcugccuuucacaauugacaaauga

SEQ ID NO: 206844 - RNA, 1410 nt, Artificial Sequence
  derived and/or modified sequence opt5 from neuraminidase__InfluenzaA__AGU92670
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaccuuuuuccugacacagggagcccuucugaacgacaagcauagcaauggcaccauuaaagaucggucuccuuaucgcacgcucauguccugucccaucggcgaggugccuagccccuacaacuccagauuugaaucuguugccuggagcgcuuccgccugccacgacgggauuaacuggcugaccaucggaaucagcggcccugauaauggggcuguggccguccugaaguauaacggaauuaucacagacaccauuaagucuuggcggaauaacauccuccgcacacaagaguccgagugugcgugcgugaauggcagcuguuucaccauuaugacggaugggccgucugacggacaggccagcuacaaaaucuuuagaaucgaaaagggcaaaauugugaaguccgucgagaugaacgcucccaauuaucauuacgaagagugcucuuguuacccugauagcuccgagaucauuugcguuugccgggacaacuggcacggcagcaaucgccccugggugucuuucaaccagaaucuggaauaucagaucggguacauuuguuccggaaucuuuggcgauaacccuagacccgacgauaaaacagggagcugcggaccggugucuuccaauggcgccaacggggucaagggauucagcuuuaaguauggcaauggcguguggauugggcggaccaaauccaucucuagccgcaagggauucgagaugaucugggacccuaacggcuggacagggaccgacaacaauuuuuccauuaaacaagauaucguuggaauuaacgaauggucuggcuacagcggguccuucgugcagcaucccgagcuuaccggccuggacuguaucagaccuugcuucugggucgaacucauucggggacgccccaaggagaauacaaucuggacgagcggcuccuccaucagcuuuuguggggugaacucugauaccguuggaugguccuggcccgacggcgcugagcugccuuucacaauugauaaauga

SEQ ID NO: 206845 - RNA, 1410 nt, Artificial Sequence
  derived and/or modified sequence opt5 from neuraminidase__InfluenzaA__AGU92681
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuaccuacucuaaggacaauuccauucggaucggcagcaaaggggauguguuugucauccgcgagccguucauuucuuguucuccccucgaaugcagaacauuuuuccugacccagggagcccuucugaacgacaagcauagcaauggcacgaucaaagaucggucuccuuaucgcacccucauguccugucccauuggcgaggugccuagccccuacaacuccagauuugaaucuguugccuggagcgcuuccgccugccacgacgggaucaacuggcugacaauuggaaucagcggcccugauaauggggcuguggccguccugaaguauaacggaaucauuaccgacacaaucaagucuuggcggaauaacauucuccgcacccaagaguccgagugugcgugcgugaauggcagcuguuucacgaucaugacagaugggccgucugacggacaggccagcuacaaaauuuuuagaaucgaaaagggcaaaaucgugaaguccgucgagaugaacgcucccaauuaucauuacgaagagugcucuuguuacccugauagcuccgagauuaucugcguuugccgggacaacuggcacggcagcaaucgccccugggugucuuucaaccagaaucuggaauaucagauuggguacaucuguuccggaauuuuuggcgauaacccuagacccaaugacaaaaccgggagcugcggaccggugucuuccaacggcgccaauggggucaagggauucagcuuuaaguauggcaacggcguguggaucgggcggacaaaauccauuucuagccgcaagggauucgagaugaucugggauccuaacggcuggaccgggaccgacaauaacuuuuccaucaaacaagacauuguuggaaucaaugaauggucuggcuacagcggguccuucgugcagcaucccgagcuuacaggccuggauuguauuagaccuugcuucugggucgaacucauccggggacgccccaaggagaacacgauuuggaccagcggcuccuccaucagcuuuugugggguuaauucugacacagugggaugguccuggcccgauggcgcugagcugccuuucaccaucgacaaauga

SEQ ID NO: 206846 - RNA, 1410 nt, Artificial Sequence
  derived and/or modified sequence opt5 from neuraminidase__InfluenzaA__AGU92692
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagagucggguccaaaggagauguguuuguuauccgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccgucgccuggucugcuagcgccugccacgacggaauuaauuggcugaccaucggcauuuccgggccugauaacggagcuguggccgugcugaaguauaauggcaucaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucuccuuuaaguauggcaauggggucuggauuggaagaacaaaaagcaucuccucucggaacggcuucgagaugauuugggacccuaauggguggaccggaaccgauaacaauuuuagcaucaagcaagacauugugggcaucaacgaaugguccggguacucuggcagcuucauccagcaucccgagcuuacaggacuggacuguauucgcccuugcuucuggguugaacucaucagaggccggcccaaagagaauacgauuuggaccuccgggagcucuaucuccuuuuguggagugaacagcgauacagucggcuggucuuggcccgacggggcugagcugccuuucaccauugauaaguga

SEQ ID NO: 206847 - RNA, 1410 nt, Artificial Sequence; identical to SEQ ID NO: 206846
  derived and/or modified sequence opt5 from neuraminidase__InfluenzaA__AGU92703

SEQ ID NO: 206848 - RNA, 1410 nt, Artificial Sequence; identical to SEQ ID NO: 206846
  derived and/or modified sequence opt5 from neuraminidase__InfluenzaA__AGU92714

SEQ ID NO: 206849 - RNA, 1410 nt, Artificial Sequence; identical to SEQ ID NO: 206846
  derived and/or modified sequence opt5 from neuraminidase__InfluenzaA__AGU92725

SEQ ID NO: 206850 - RNA, 1410 nt, Artificial Sequence; identical to SEQ ID NO: 206846
  derived and/or modified sequence opt5 from neuraminidase__InfluenzaA__AGU92736

SEQ ID NO: 206851 - RNA, 1410 nt, Artificial Sequence; identical to SEQ ID NO: 206846
  derived and/or modified sequence opt5 from neuraminidase__InfluenzaA__AGU92747

SEQ ID NO: 206852 - RNA, 1410 nt, Artificial Sequence; identical to SEQ ID NO: 206846
  derived and/or modified sequence opt5 from neuraminidase__InfluenzaA__AGU92758

SEQ ID NO: 206853 - RNA, 1410 nt, Artificial Sequence; identical to SEQ ID NO: 206843
  derived and/or modified sequence opt5 from neuraminidase__InfluenzaA__AGU92769

SEQ ID NO: 206854 - RNA, 1410 nt, Artificial Sequence; identical to SEQ ID NO: 206843
  derived and/or modified sequence opt5 from neuraminidase__InfluenzaA__AGU92780

SEQ ID NO: 206855 - RNA, 1410 nt, Artificial Sequence
  derived and/or modified sequence opt5 from neuraminidase__InfluenzaA__AGU92791
augaaccccaaucagaagaucauuaccaucggcagcgugugcaugacaauugggauggccaaccugauccuccaaauuggaaauaucaucuccauuuggaucucucacagcauucagcugagaaaccagucccagaucgagacguguaaucaaucugucauuaccuacgaaaacaauacauggguuaaccagaccuaugugaauaucagcaacacaaauuucgcugccggccaguccguggucucugugaaacuugcggggaacagcucccugugcccuguuagcggaugggcuauuuacucuaaggacaauuccauccggaucggcagcaaaggggauguguuugucauucgcgagccguucaucucuuguucuccccucgaaugcagaaucuuuuuccugacccagggagcccuucugaacgacaagcauagcaauggcacaauuaaagaucggucuccuuaucgcacccucauguccugucccauuggcgaggugccuagccccuacaacuccagauuugaaucuguugccuggagcgcuuccgccugccacgacgggaucaacuggcugacgaucggaauuagcggcccugauaauggggcuguggccguccugaaguauaacggaaucauuaccgacacaaucaagucuuggcggaauaacauucuccgcacccaagaguccgagugugcgugcgugaauggcagcuguuucacaaucaugaccgaugggccgucugacggacaggccagcuacaaaaucuuuagaauugaaaagggcaaaaucgugaaguccgucgagaugaacgcucccaauuaucauuacgaagagugcucuuguuacccugauagcuccgagauuaucugcguuugccgggacaacuggcacggcagcaaucgccccugggugucuuucaaccagaaucuggaauaucagauuggguacaucuguuccggaauuuuuggcgauaacccuagacccaaugacaaaacggggagcugcggaccggugucuuccaacggcgccaauggggucaagggauucagcuuuaaguauggcaacggcguguggaucgggcggacaaaauccaucucuagccgcaagggauucgagaugauuugggauccuaacggcuggaccgggacagacaauaacuuuuccaucaaacaagacauuguuggaaucaaugaauggucuggcuacagcggguccuucgugcagcaucccgagcuuaccggccuggauuguauuagaccuugcuucugggucgaacucauccggggacgccccaaggagaacaccaucuggacaagcggcuccuccauuagcuuuugugggguuaauucugacacggugggaugguccuggcccgauggcgcugagcugccuuucaccaucgacaaauga

SEQ ID NO: 206856 - RNA, 1410 nt, Artificial Sequence; identical to SEQ ID NO: 206843
  derived and/or modified sequence opt5 from neuraminidase__InfluenzaA__AGU92802

SEQ ID NO: 206857 - RNA, 1410 nt, Artificial Sequence; identical to SEQ ID NO: 206843
  derived and/or modified sequence opt5 from neuraminidase__InfluenzaA__AGU92813

SEQ ID NO: 206858 - RNA, 1410 nt, Artificial Sequence; identical to SEQ ID NO: 206843
  derived and/or modified sequence opt5 from neuraminidase__InfluenzaA__AGU92824

SEQ ID NO: 206859 - RNA, 1410 nt, Artificial Sequence
  derived and/or modified sequence opt5 from neuraminidase__InfluenzaA__AGU92846
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagagucggguccaaaggagauguguuuguuauccgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccgucgccuggucugcuagcgccugccacgacggaauuaauuggcugaccaucggcauuuccgggccugauaacggagcuguggccgugcugaaguauaauggcaucaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucgcuuuuaaguauggcaauggggucuggauuggaagaacaaaauccaucagcucccggaacggcuucgagaugauuugggacccuaauggguggaccggaaccgauaacaauuuuucuaucaagcaagacauugugggcaucaacgaauggagcggguacuccggcucuuucauccagcaucccgagcuuacaggacuggacuguauucgcccuugcuucuggguugaacucaucagaggccggcccaaagagaauacgauuuggaccagcggguccagcaucucuuuuuguggagugaacuccgauacagucggcuggagcuggcccgacggggccgagcugccuuucaccauugauaaguga

SEQ ID NO: 206860 - RNA, 1410 nt, Artificial Sequence
  derived and/or modified sequence opt5 from neuraminidase__InfluenzaA__AGU92868
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaauuugcgggaaauucuagccuuugcccuguuuccggcugggcuauuuacagcaaggacaacucugugagagucggguccaaaggagauguguucguuauccgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccgucgccuggucugcuagcgccugccacgacggaauuaauuggcucaccaucggcauuuccgggccugauaacggagcuguggccgugcugaaguauaauggcaucaucacagacaccauuaagagcuggagaaacaauauccugcggacacaagagucugagugugcgugcgucaacggguccuguuuuaccguuaugacggauggaccgagcaauggccaggccucuuacaaaauuuuccgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuuuaaccagaaucucgaauaucagaucggauacauuuguucuggcaucuucggggacaacccucgccccaaugauaaaaccggauccugcggcccgguuagcucuaacggggccaacggagugaagggcuuuuccuucaaguauggcaauggggucuggauuggaagaacaaaaagcaucuccucucggaacggcuuugagaugauuugggacccuaauggguggaccggaaccgauaacaauuucagcaucaagcaagacauugugggcaucaacgaaugguccggguacucuggcagcuucauccagcaucccgagcugacaggacuugacuguauucgcccuugcuuuuggguugaacugaucagaggccggcccaaagagaauacgauuuggaccuccgggagcucuaucuccuucuguggagugaacagcgauacagucggcuggucuuggcccgacggggcugagcucccuuuuaccauugauaaguga

SEQ ID NO: 206861 - RNA, 1410 nt, Artificial Sequence
  derived and/or modified sequence opt5 from neuraminidase__InfluenzaA__AGU92890
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagagucggguccaaaggagauguguuuguuauccgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccgucgccuggucugcuagcgccugccacgacggaauuaauuggcugaccaucggcauuuccgggccugauaacggagcuguggccgugcugaaguauaauggcaucaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucuccuuuaaguauggcaauggggucuggauuggaagaacaaaaagcaucuccucucggaacggcuucgagaugauuugggacccuaauggguggaccgaaaccgauaacaauuuuagcaucaagcaagacauugugggaaucaacgagugguccggcuacucugggagcuucauccagcaucccgaacuuacaggccuggacuguauucgcccuugcuucuggguugagcucaucagaggacggcccaaagagaauacgauuuggaccuccggcagcucuaucuccuuuuguggggugaacagcgauacagucggauggucuuggcccgacggcgcugaacugccuuucaccauugauaaguga

SEQ ID NO: 206862 - RNA, 1410 nt, Artificial Sequence; identical to SEQ ID NO: 206843
  derived and/or modified sequence opt5 from neuraminidase__InfluenzaA__AGU92901

SEQ ID NO: 206863 - RNA, 1410 nt, Artificial Sequence; identical to SEQ ID NO: 206843
  derived and/or modified sequence opt5 from neuraminidase__InfluenzaA__AGU92912

SEQ ID NO: 206864 - RNA, 1410 nt, Artificial Sequence; identical to SEQ ID NO: 206843
  derived and/or modified sequence opt5 from neuraminidase__InfluenzaA__AGU92923

SEQ ID NO: 206865 - RNA, 1410 nt, Artificial Sequence; identical to SEQ ID NO: 206846
  derived and/or modified sequence opt5 from neuraminidase__InfluenzaA__AGU92934

SEQ ID NO: 206866 - RNA, 1410 nt, Artificial Sequence; identical to SEQ ID NO: 206846
  derived and/or modified sequence opt5 from neuraminidase__InfluenzaA__AGU92945

SEQ ID NO: 206867 - RNA, 1410 nt, Artificial Sequence; identical to SEQ ID NO: 206846
  derived and/or modified sequence opt5 from neuraminidase__InfluenzaA__AGU92956

SEQ ID NO: 206868 - RNA, 1410 nt, Artificial Sequence; identical to SEQ ID NO: 206843
  derived and/or modified sequence opt5 from neuraminidase__InfluenzaA__AGU92967

SEQ ID NO: 206869 - RNA, 1410 nt, Artificial Sequence; identical to SEQ ID NO: 206843
  derived and/or modified sequence opt5 from neuraminidase__InfluenzaA__AGU92978

SEQ ID NO: 206870 - RNA, 1410 nt, Artificial Sequence
  derived and/or modified sequence opt5 from neuraminidase__InfluenzaA__AGU92989
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagagucggguccaaaggagauguguuuguuauccgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccgucgccuggucugcuagcgccugccacgacggaauuaauuggcugaccaucggcauuuccgggccugauaacggagcuguggccgugcugaaguauaauggcaucaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucuccuuuaaguauggcaauggggucuggauuggaagaacaaaaagcaucuccucucggaacggcuucgagaugauuugggacccuaauggguggaccggaaccgauaacaauuuuagcaucaagcaagacauugugggcaucaacgaaugguccggguacucuggcagcuucguucagcaucccgagcuuacaggacuggacuguauccgcccuugcuucuggguggaacucauuagaggccggcccaaagagaauacgaucuggaccuccgggagcucuauuuccuuuuguggagucaacagcgauacagugggcuggucuuggcccgacggggcugagcugccuuucaccaucgauaaguga

SEQ ID NO: 206871 - RNA, 1410 nt, Artificial Sequence; identical to SEQ ID NO: 206860
  derived and/or modified sequence opt5 from neuraminidase__InfluenzaA__AGU93000

SEQ ID NO: 206872 - RNA, 1410 nt, Artificial Sequence; identical to SEQ ID NO: 206861
  derived and/or modified sequence opt5 from neuraminidase__InfluenzaA__AGU93011

SEQ ID NO: 206873 - RNA, 1365 nt, Artificial Sequence; identical to SEQ ID NO: 203414
  derived and/or modified sequence opt5 from neuraminidase__InfluenzaA__AGU93022

SEQ ID NO: 206874 - RNA, 1410 nt, Artificial Sequence
  derived and/or modified sequence opt5 from neuraminidase__InfluenzaA__AGU93034
augaaccccacccagaagaucauuacaaucggcagcgugugcaugacgauugggauggccaaucugauccuccaaauuggaaacaucaucuccauuuggaucucucacagcauucagcugggcaaucagaaccagaucgagaccuguaaucaauccgucauuacauacgaaaacaauaccuggguuaaccagacauaugugaauaucucuaacaccaauuucgcugccgggcagagcguggcguccgucaaacuugcuggaaacucuagccugugcccuguguccggcugggccauuuacagcaaggacaauucuaucagaaucggguccaaaggagauguuuuugugauucgggagccguucaucagcuguucuccccucgaaugccgcacauuuuuccugacccagggcgcccuucugaacgacaagcauuccaauggcacgauuaaagauagaagcccuuaucggacccucaugucuugucccaucggggaggucccuucccccuacaacagccgcuuugaauccguggcuuggucugccagcgcuugccacgacggaauuaacuggcugacaaucggcaucuccgggccugauaauggagccguugcggugcugaaguauaacggcauuaucaccgacacaauuaagagcuggagaaauaacauccuccggacccaagagucugagugugccugcgucaauggguccuguuucacgauuaugacagauggaccgagcgacggccaggcuucuuacaaaaucuuucgcaucgaaaagggcaaaauugucaagagcguggagaugaacgcccccaauuaucauuacgaagagugcuccuguuacccugauucuagcgagauuaccugcgugugcagagacaacuggcacggguccaaucggcccuggguuagcuucaaccagaaucuggaauaucagaucggauacaucuguucuggcauuuuuggggauaacccucgccccaaugacaaaacaggauccugcggcccggugagcucuaacggggcuaauggagugaagggcuucuccuuuaaguauggcaacggggucuggaucggaagaaccaaaagcauuuccucucggaagggcuucgagaugaucugggauccuaacggguggaccggaacagacaauaacuuuagcaucaaacaagacauugugggcaucaaugaaugguccggguacucuggcagcuucguucagcaucccgagcuuacgggacuggauuguauucgcccuugcuucuggguggaacucaucagaggccggcccaaggagaacaccauuuggacauccgggagcucuaucuccuuuuguggagucaauagcgacaccgugggcuggucuuggcccgauggggccgagcugccuuucacaaucgacaaauga

SEQ ID NO: 206875 - RNA, 1410 nt, Artificial Sequence; identical to SEQ ID NO: 206182
  derived and/or modified sequence opt5 from neuraminidase__InfluenzaA__AGU93045

SEQ ID NO: 206876 - RNA, 1410 nt, Artificial Sequence; identical to SEQ ID NO: 206843
  derived and/or modified sequence opt5 from neuraminidase__InfluenzaA__AGU93056

SEQ ID NO: 206877 - RNA, 1410 nt, Artificial Sequence; identical to SEQ ID NO: 205170
  derived and/or modified sequence opt5 from neuraminidase__InfluenzaA__AGV98980

SEQ ID NO: 206878 - RNA, 1410 nt, Artificial Sequence; identical to SEQ ID NO: 205170
  derived and/or modified sequence opt5 from neuraminidase__InfluenzaA__AGV98993

SEQ ID NO: 206879 - RNA, 1410 nt, Artificial Sequence; identical to SEQ ID NO: 205170
  derived and/or modified sequence opt5 from neuraminidase__InfluenzaA__AGV99005

SEQ ID NO: 206880 - RNA, 1410 nt, Artificial Sequence; identical to SEQ ID NO: 205170
  derived and/or modified sequence opt5 from neuraminidase__InfluenzaA__AGV99017

SEQ ID NO: 206881 - RNA, 1410 nt, Artificial Sequence; identical to SEQ ID NO: 205170
  derived and/or modified sequence opt5 from neuraminidase__InfluenzaA__AGV99040

SEQ ID NO: 206882 - RNA, 1410 nt, Artificial Sequence
  derived and/or modified sequence opt5 from neuraminidase__InfluenzaA__AGV99052
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuguuauuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaaccgagguucuguggacauccaauucuaucguggucuucugugggaccagcggaacauacggcacgggguccuggccugauggcgcugaccucaaccugaugcccauuuga

SEQ ID NO: 206883 - RNA, 1410 nt, Artificial Sequence
  derived and/or modified sequence opt5 from neuraminidase__InfluenzaA__AGV99100
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcugugugaaccggugcuuuuauguugaacugaucagaggccgcaaggaggaaaccgaggugcuguggacauccaauucuauugucguguucugugggaccagcggaacauacggcacgggguccuggccugauggcgcugaccucaaccugaugcccaucuga

SEQ ID NO: 206884 - RNA, 1410 nt, Artificial Sequence; identical to SEQ ID NO: 205170
  derived and/or modified sequence opt5 from neuraminidase__InfluenzaA__AGV99112

SEQ ID NO: 206885 - RNA, 1410 nt, Artificial Sequence; identical to SEQ ID NO: 205170
  derived and/or modified sequence opt5 from neuraminidase__InfluenzaA__AGV99124

SEQ ID NO: 206886 - RNA, 1410 nt, Artificial Sequence; identical to SEQ ID NO: 205170
  derived and/or modified sequence opt5 from neuraminidase__InfluenzaA__AGV99136

SEQ ID NO: 206887 - RNA, 1410 nt, Artificial Sequence; identical to SEQ ID NO: 205170
  derived and/or modified sequence opt5 from neuraminidase__InfluenzaA__AGV99148

SEQ ID NO: 206888 - RNA, 1410 nt, Artificial Sequence; identical to SEQ ID NO: 205170
  derived and/or modified sequence opt5 from neuraminidase__InfluenzaA__AGV99160

SEQ ID NO: 206889 - RNA, 1410 nt, Artificial Sequence; identical to SEQ ID NO: 205170
  derived and/or modified sequence opt5 from neuraminidase__InfluenzaA__AGV99172

SEQ ID NO: 206890 - RNA, 1410 nt, Artificial Sequence; identical to SEQ ID NO: 205170
  derived and/or modified sequence opt5 from neuraminidase__InfluenzaA__AGV99196

SEQ ID NO: 206891 - RNA, 1410 nt, Artificial Sequence; identical to SEQ ID NO: 205170
  derived and/or modified sequence opt5 from neuraminidase__InfluenzaA__AGV99208

SEQ ID NO: 206892 - RNA, 1410 nt, Artificial Sequence; identical to SEQ ID NO: 205170
  derived and/or modified sequence opt5 from neuraminidase__InfluenzaA__AGV99959

SEQ ID NO: 206893 - RNA, 1410 nt, Artificial Sequence; identical to SEQ ID NO: 206381
  derived and/or modified sequence opt5 from neuraminidase__InfluenzaA__AGW00005

SEQ ID NO: 206894 - RNA, 1410 nt, Artificial Sequence; identical to SEQ ID NO: 205170
  derived and/or modified sequence opt5 from neuraminidase__InfluenzaA__AGW00068

SEQ ID NO: 206895 - RNA, 1410 nt, Artificial Sequence
  derived and/or modified sequence opt5 from neuraminidase__InfluenzaA__AGW00080
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 206896 - RNA, 1410 nt, Artificial Sequence
  derived and/or modified sequence opt5 from neuraminidase__InfluenzaA__AGW00104
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcggggaggccgacacaaagauccuguuuaucgaagagggaaaaauuguucauaccuccacacucucuggcagcgcgcaacacguggaagagugcuccugcuaucccagauacccuggggugcggugugucugccgcgauaacuggaagggaagcaauagacccaucguggacauuaacaucaaggaucacucuauuguuuccagcuacguguguucuggccuggucggcgacaccccgcggaaaaaugacagcuccucuagcucccauugccuugauccuaacaaugaagaagggggacacggcgugaaggggugggccuucgacgauggaaacgacguuuggaugggccgcacgaucaaugagacaagcagacugggguaugagaccuuuaaagugaucgagggauggucuaaccccaaguccaaacuccagauuaaucggcaggucaucguggaucgcggcgacagaagcggcuacucugggauuuucuccgucgaaggaaagagcuguaucaaccggugcuuuuauguggagcugauuagaggccgcaaagaagagaccgagguucuguggacauccaauucuaucguggucuucugugggaccagcggaacauacggcacgggguccuggccugauggcgcugaccucaaccugaugcccauuuga

SEQ ID NO: 206897 - RNA, 1410 nt, Artificial Sequence; identical to SEQ ID NO: 206895
  derived and/or modified sequence opt5 from neuraminidase__InfluenzaA__AGW00116

SEQ ID NO: 206898 - RNA, 1410 nt, Artificial Sequence; identical to SEQ ID NO: 206895
  derived and/or modified sequence opt5 from neuraminidase__InfluenzaA__AGW00128

SEQ ID NO: 206899 - RNA, 1410 nt, Artificial Sequence; identical to SEQ ID NO: 205170
  derived and/or modified sequence opt5 from neuraminidase__InfluenzaA__AGW00140

SEQ ID NO: 206900 - RNA, 1410 nt, Artificial Sequence; identical to SEQ ID NO: 205170
  derived and/or modified sequence opt5 from neuraminidase__InfluenzaA__AGW00152

SEQ ID NO: 206901 - RNA, 1410 nt, Artificial Sequence; identical to SEQ ID NO: 206895
  derived and/or modified sequence opt5 from neuraminidase__InfluenzaA__AGW00164

SEQ ID NO: 206902 - RNA, 1410 nt, Artificial Sequence; identical to SEQ ID NO: 205170
  derived and/or modified sequence opt5 from neuraminidase__InfluenzaA__AGW00176

SEQ ID NO: 206903 - RNA, 1410 nt, Artificial Sequence; identical to SEQ ID NO: 205170
  derived and/or modified sequence opt5 from neuraminidase__InfluenzaA__AGW00188

SEQ ID NO: 206904 - RNA, 1410 nt, Artificial Sequence; identical to SEQ ID NO: 205170
  derived and/or modified sequence opt5 from neuraminidase__InfluenzaA__AGW00712

SEQ ID NO: 206905 - RNA, 1410 nt, Artificial Sequence; identical to SEQ ID NO: 205170
  derived and/or modified sequence opt5 from neuraminidase__InfluenzaA__AGW00724

SEQ ID NO: 206906 - RNA, 1410 nt, Artificial Sequence
  derived and/or modified sequence opt5 from neuraminidase__InfluenzaA__AGW00736
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagaugaugcuuugugaacccacaauuaucgagagaaauauuaccgaaaucguuuaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugugucuugcgacccggauaaguguuaccaauucgcucugggacagggcaccacacuuaauaacguccauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuaucgaaggauggucugaucccaaauccaagcuccagauuaaccgccaggugaucgucgaccggggcgauagaagcggcuacucugggauuuucuccguggagggaaaaagcuguaucaaucggugcuuuuaugucgaacugauuagaggccgcaaggaggaaaccgaggugcuguggacauccaacucuaucguuguguucugugggaccagcggaacauacggcacgggguccuggccugacggcgcugaucucaaucugaugcccauuuga

SEQ ID NO: 206907 - RNA, 1410 nt, Artificial Sequence
  derived and/or modified sequence opt5 from neuraminidase__InfluenzaA__AGW00748
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcuguggacauccaauucuaucguuguguucugugggaccagcggaacauacggcacgggguccuggccugauggcgcugaccucaaccugaugcccauuuga

SEQ ID NO: 206908 - RNA, 1410 nt, Artificial Sequence
  derived and/or modified sequence opt5 from neuraminidase__InfluenzaA__AGW00760
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccaggucaaucgccaggugauugucgaucggggcgacagaagcggcuacucugggaucuucuccguggagggaaaaagcuguauuaaccggugcuuuuauguugaacugaucagaggccgcaaggaggaaaccgaggugcuguggacauccaauucuauugucguguucugugggaccagcggaacauacggcacgggguccuggccugauggcgcugaccucaaccugaugcccaucuga

SEQ ID NO: 206909 - RNA, 1410 nt, Artificial Sequence; identical to SEQ ID NO: 205170
  derived and/or modified sequence opt5 from neuraminidase__InfluenzaA__AGW00784

SEQ ID NO: 206910 - RNA, 1410 nt, Artificial Sequence; identical to SEQ ID NO: 205170
  derived and/or modified sequence opt5 from neuraminidase__InfluenzaA__AGW00796

SEQ ID NO: 206911 - RNA, 1410 nt, Artificial Sequence; identical to SEQ ID NO: 206895
  derived and/or modified sequence opt5 from neuraminidase__InfluenzaA__AGW00808

SEQ ID NO: 206912 - RNA, 1410 nt, Artificial Sequence; identical to SEQ ID NO: 206399
  derived and/or modified sequence opt5 from neuraminidase__InfluenzaA__AGW00820

SEQ ID NO: 206913 - RNA, 1410 nt, Artificial Sequence; identical to SEQ ID NO: 205170
  derived and/or modified sequence opt5 from neuraminidase__InfluenzaA__AGW00832

SEQ ID NO: 206914 - RNA, 1410 nt, Artificial Sequence
  derived and/or modified sequence opt5 from neuraminidase__InfluenzaA__AGW00844
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacccgcugaguaccggaauuggagcaagccucagugugggauuaccggauuugcccccuucuccaaagacaacucuauccgccucagcgcgggcggggauaucugggugacaagagagccuuaugucuccugcgacccggauaaguguuaccaauuugcucugggacagggcaccacacuuaauaacgugcauucuaauaacaccguucgggaccgcacgcccuauagaacacugcucaugaaugaacugggggugccuuuccaccugggaaccaagcaggucugcauugccuggagcuccagcucuugucaugauggcaaagccuggcuccacgugugcaucacaggcgacgauaagaacgcuaccgccuccuuuauuuacaaugggcggcugguugacagcguggucucuugguccaaagagauccuucgcacccaggaaagcgagugugugugcauuaacggaacauguacgguggucaugaccgauggcucugcuuccgggaaggccgacacaaaaauccuguucaucgaggaaggaaagauuguucauaccagcacacucuccggcucugcgcaacacguggaggaaugcagcugcuaucccagauacccuggggugcggugugucugccgcgauaacuggaagggauccaauagacccaucguggacauuaacaucaaagaucacagcauuguuucuuccuacguguguagcggccuggucggcgacaccccgcggaagaaugacucuagcuccucuagccauugccuugauccuaacaaugaggaagggggacacggcgugaaagggugggccuuugacgauggaaacgacguuuggaugggccgcacgaucaaugagacauccagacugggguaugagaccuucaaggugaucgaaggauggagcaaccccaaaucuaagcuccagauuaaucggcaggucaucguggaucgcggcgacagauccggcuacagcgggaucuuuucugucgagggaaaauccuguauuaaccggugcuucuauguggaacugauuagaggccgcaaggaggaaaccgagguucuguggacaagcaauuccaucguggucuucugugggaccucuggaacauacggcacggggagcuggccugauggcgcugaccucaaccugaugcccauuuga

SEQ ID NO: 206915 - RNA, 1410 nt, Artificial Sequence; identical to SEQ ID NO: 206907
  derived and/or modified sequence opt5 from neuraminidase__InfluenzaA__AGW00868

SEQ ID NO: 206916 - RNA, 1410 nt, Artificial Sequence
  derived and/or modified sequence opt5 from neuraminidase__InfluenzaA__AGW00880
augaaccccaaucagaagaucauuaccaucggcagcgugucccugacaauuucuacgaucugcuucuuuaugcagauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacgugugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcaucgccugguccucuagcuccugucaugacggaaaggccuggcuccacguuugcauuacaggcgaugacaagaacgcuaccgccagcuucaucuacaauggcaaacugguggauucugucguguccuggagcaaggagauucuucggacccaggaaucugagugugugugcaucaacgggacauguacggucguuaugaccgacggauccgcuagcggcaaagccgauacaaagauucuguuuaucgaggaagggaagaucgugcauaccuccacacucucuggaagcgcgcaacacguggaggaaugcuccugcuauccccgcuacccugacgucagaugugugugccgggauaacuggaaaggcagcaaucgccccauuguugacaucaacauuaaggaccacucuaucguguccagauacgucuguagcgggcuggugggagauaccccgcggaaaaaugacucuagcuccucuagccauugccuugauccuaacaaugaggaaggcggccacgggguuaagggaugggccuucgacgauggcaacgacguguggauggggcgcacgauuaaugagacauccagacugggauaugagaccuuuaaagucaucgaaggcuggagcaaccccaagucuaaacuccagaucaaucggcaagugauugucgaucgcggggacagauccggauacagcggcaucuucucuguggagggcaaguccuguauuaaccggugcuuuuauguugaacugaucagagggcgcaaggaggaaaccgaggugcuguggacaagcaauuccauugucguguucuguggaaccucuggcacauacgggacgggaagcuggccugauggcgcugaccucaaccugaugcccaucuga

SEQ ID NO: 206917 - RNA, 1410 nt, Artificial Sequence
  derived and/or modified sequence opt5 from neuraminidase__InfluenzaA__AGW00892
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaaccugcugaguaccggaauuggagcaagccccagugugggauuaccggauucgccccuuuuuccaaagacaacucuauccgccucagcgcgggcggggauaucugggugacaagagagccguaugucuccugcgaccccgauaaguguuaccaauucgcucugggacagggcaccacacuuaauaacgugcauucuaauaacaccguucgggaccgcacgccuuauagaacacugcucaugaaugaacugggggugcccuuucaccugggaaccaagcaggucugcauugccuggagcuccagcucuugucaugauggcaaagccuggcuccacgugugcaucacaggcgacgauaagaacgcuaccgccuccuucauuuacaaugggcggcugguugacagcguggucucuugguccaaagagauccuucgcacccaggaaagcgagugugugugcauuaacggaacauguacgguggucaugaccgauggcucugcuuccgggaaggccgacacaaaaauccuguuuaucgaggaaggaaagauuguucauaccagcacacucuccggcucugcgcaacacguggaggaaugcagcugcuauccuagauaccccggggugcggugugucugccgcgauaacuggaagggauccaauagaccgaucguggacauuaacaucaaagaucacagcauuguuucuuccuacguguguagcggccuggucggcgacaccccucggaagaaugacucuagcuccucuagccauugccuugaucccaacaaugaggaagggggacacggcgugaaagggugggccuucgacgauggaaacgacguuuggaugggccgcacgaucaaugagacauccagacugggguaugagaccuuuaaggugaucgaaggauggagcaacccuaaaucuaagcuccagaugaaucggcaggucauuguggaucgcggcgacagauccggcuacagcgggaucuucucugucgagggaaaauccuguauuaaccggugcuuuuauguggaacugaucagaggccgcaaggaggaaaccgagguucuguggacaagcaauuccauuguggucuucugugggaccucuggaacauacggcacggggagcuggcccgauggcgcugaccucaaccugaugcccaucuga

SEQ ID NO: 206918 - RNA, 1410 nt, Artificial Sequence
  derived and/or modified sequence opt5 from neuraminidase__InfluenzaA__AGW00904
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcggaccggacaaguguuaccaauucgcucugggccaggggaccacacuuaauaacaugcauagcaauaacaccgugcgggaucgcacgcccuauagaacacugcucaugaaugaacugggaguuccuuuucaccugggcaccaaacaggugugcauugccugguccucuagcuccugucaugacggcaaggccuggcuccacgucugcaucacaggggaugacaagaacgcuaccgccagcuucauuuacaauggacggcugguggauucuguuguguccuggagcaaagagauccuucgcacccaggaaucugagugugucugcauuaacggcacauguacgguggugaugaccgacggguccgcuagcggaaaggccgauacaaaaauccuguuuaucgaggaaggcaagauuguccauaccuccacacucucugggagcgcgcaacacguugaggaaugcuccugcuaucccagauacccuggagugcggugugugugccgcgacaacuggaagggcagcaauagacccaucgucgauauuaacaucaaagaccacucuauuguguccagcuacguuuguucuggccuggugggggauaccccgcggaagaaugacagcuccucuagcucccauugccuugacccuaacaaugaggaaggaggccacggggucaaaggaugggccuucgaugacggcaacgauguguggauggggcgcacgaucaaugagacaagcagacugggauaugagaccuuuaagguuaucgaaggcuggucuaaccccaaauccaagcuccagauuaaucgccaggugaucgucgaccggggcgauagaagcggguacucuggaauuuucuccguggagggcaaaagcuguaucaaccggugcuuuuaugucgaacugauuagagggcgcaaggaggaaaccgaggugcuguggacauccaauucuaucguuguguucuguggaaccagcggcacauacgggacgggcuccuggccugacggagcugaucucaaccugaugcccauuuga

SEQ ID NO: 206919 - RNA, 1410 nt, Artificial Sequence
  derived and/or modified sequence opt5 from neuraminidase__InfluenzaA__AGW00916
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugugcgaccggacgcccuaucgcacacugcucaugaaugaacuggggguuccuuuucaccugggaaccaaacagguguguauugccugguccucuagcuccugccaugauggcaaggccuggcuccacgucuguaucacaggcgacgauaagaacgcuaccgccagcuucauuuacaaugggagacugguggacucuguuguguccuggagcaaagagauccuucggacccaggaaucugagugcgucuguauuaacggaacaugcacgguggugaugaccgauggcuccgcuagcgggaaggccgacacaaaaauccuguuuaucgaggaaggaaagauuguccauaccuccacacucucuggcagcgcgcaacacguugaggaaugcuccuguuauccccgcuacccuggggugagaugcgugugucgggauaacuggaagggaagcaaucgccccaucgucgacauuaacaucaaagaucacucuauuguguccagcuacguuugcucuggccuggugggcgacaccccgagaaagaaugacagcuccucuagcucccauugucuugauccuaacaaugaggaagggggacacggcgucaaagggugggccuucgacgauggaaacgacguguggaugggccggacgaucaaugagacaagccgccugggguaugagaccuuuaagguuaucgaaggauggucuaaccccaaauccaagcuccagauuaauagacaggugaucgucgaucggggcgaccgcagcggcuacucugggauuuucuccguggagggaaaaagcugcaucaacagauguuuuuaugucgaacugauucggggcagaaaggaggaaaccgaggugcuguggacauccaauucuaucguuguguucugcgggaccagcggaacauacggcacgggguccuggccugauggcgcugaccucaaccugaugcccauuuga

SEQ ID NO: 206920 - RNA, 1410 nt, Artificial Sequence; identical to SEQ ID NO: 206895
  derived and/or modified sequence opt5 from neuraminidase__InfluenzaA__AGW00934

SEQ ID NO: 206921 - RNA, 1410 nt, Artificial Sequence
  derived and/or modified sequence opt5 from neuraminidase__InfluenzaA__AGW01247
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaagacagcuccucuagcucccauugccuugauccuaauaacgaggaagggggacacggcgugaaggggugggccuucgacgauggaaaugacguuuggaugggccgcacgaucaacgagacaagcagacugggguaugagaccuuuaaagugaucgaaggauggucuaaucccaaguccaaacuccagauuaaccggcaggucaucguggaucgcggcgacagaagcggcuacucugggauuuucuccgucgagggaaagagcuguaucaaucggugcuuuuauguggaacugauuagaggccgcaaggaggaaaccgagguucuguggacauccaacucuaucguggucuucugugggaccagcggaacauacggcacgggguccuggccugauggcgcugaccucaaucugaugcccauuuga

SEQ ID NO: 206922 - RNA, 1410 nt, Artificial Sequence; identical to SEQ ID NO: 205170
  derived and/or modified sequence opt5 from neuraminidase__InfluenzaA__AGW01259

SEQ ID NO: 206923 - RNA, 1410 nt, Artificial Sequence; identical to SEQ ID NO: 206907
  derived and/or modified sequence opt5 from neuraminidase__InfluenzaA__AGW01298

SEQ ID NO: 206924 - RNA, 1410 nt, Artificial Sequence; identical to SEQ ID NO: 206399
  derived and/or modified sequence opt5 from neuraminidase__InfluenzaA__AGW01322

SEQ ID NO: 206925 - RNA, 1410 nt, Artificial Sequence
  derived and/or modified sequence opt5 from neuraminidase__InfluenzaA__AGW01334
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaagcugagguucuguggaccuccaauucuaucguggucuucugugggacaagcggaaccuacggcacaggguccuggccugauggcgccgaccucaaccugaugcccauuuga

SEQ ID NO: 206926 - RNA, 1410 nt, Artificial Sequence; identical to SEQ ID NO: 205170
  derived and/or modified sequence opt5 from neuraminidase__InfluenzaA__AGW01346

SEQ ID NO: 206927 - RNA, 1410 nt, Artificial Sequence
  derived and/or modified sequence opt5 from neuraminidase__InfluenzaA__AGW01358
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccaccgaguaccggaauugguccaagccucagugugggauuacaggauucgcucccuuuucuaaagacaacagcauccgccucuccgccggcggggauaucugggugaccagagagccuuaugucucuugcgacccggauaaguguuaccaauucgcgcugggacagggcacaacccuuaauaacgugcauagcaauaacacgguucgggaccgcacacccuauagaacccugcucaugaaugaacugggggugccuuuucaccugggaacaaagcaggucugcauugcuugguccucuagcuccugucaugauggcaaagccuggcuccacgugugcaucaccggcgacgauaagaacgccaccgcuagcuucauuuacaaugggcggcugguugacucuguggucuccuggagcaaagagauccuucgcacacaggaaucugagugugugugcauuaacggaacguguaccguggucaugacagauggcuccgccagcgggaaggcugacaccaaaauccuguuuaucgaggaaggaaagauuguucauacauccacccucucuggcagcgcccaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacacgccgcggaagaaugacagcuccucuagcucccauugccuugauccuaacaaugaggaagggggacacggcgugaaagggugggcguucgacgauggaaacgacguuuggaugggccgcacaaucaaugagaccagcagacugggguaugagaccuuuaaggugaucgaaggauggucuaaccccaaauccaagcuccagauuaaucggcaggucaucguggaucgcggcgacagaagcggcuacucugggauuuucuccgucgagggaaaaagcuguaucaaccggugcuuuuauguggaacugauuagaggccgcaaggaggaaacagagguucuguggaccuccaauucuaucguggucuucugugggacaagcggaacguacggcaccggguccuggccugauggcgccgaccucaaccugaugcccauuuga

SEQ ID NO: 206928 - RNA, 1410 nt, Artificial Sequence; identical to SEQ ID NO: 205170
  derived and/or modified sequence opt5 from neuraminidase__InfluenzaA__AGW01370

SEQ ID NO: 206929 - RNA, 1410 nt, Artificial Sequence; identical to SEQ ID NO: 205170
  derived and/or modified sequence opt5 from neuraminidase__InfluenzaA__AGW01382

SEQ ID NO: 206930 - RNA, 1410 nt, Artificial Sequence
  derived and/or modified sequence opt5 from neuraminidase__InfluenzaA__AGW01394
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuaucguguccuggagcaaagacauucuucgcacccaggagucugaaugugucugcaucaauggaacauguacgguggugaugaccgauggcuccgcuagcgggaaggccgacacaaaaauccuguuuauugaggagggaaagaucguccauaccuccacacucucuggcagcgcgcaacacguugaagagugcuccugcuaucccagauacccuggggugcggugugugugccgcgauaacuggaagggaagcaacagacccauugucgacaucaauauuaaagaccacucuaucguguccagcuacguuuguucuggccuggugggcgauaccccgcggaagaacgacagcuccucuagcucccauugccuugauccuaauaacgaagaagggggacacggcgucaaagggugggccuucgacgauggaaaugacguguggaugggccgcacgaucaacgagacaagcagacugggguaugagaccuuuaagguuauugagggauggucuaaucccaaauccaagcuccagaucaaccgccaggugauugucgaucggggcgacagaagcggcuacucugggaucuucuccguggaaggaaaaagcuguauuaaucggugcuuuuaugucgagcugaucagaggccgcaaggaagagaccgaagugcuguggacauccaacucuauuguuguguucugugggaccagcggaacauacggcacgggguccuggccugauggcgcugaccucaaucugaugcccaucuga

SEQ ID NO: 206931 - RNA, 1410 nt, Artificial Sequence
  derived and/or modified sequence opt5 from neuraminidase__InfluenzaA__AGW01406
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacaugcauagcaauaacaccgugcgggaucgcacgcccuauagaacacugcucaugaaugaacugggcguuccuuuucaccuggggaccaaacaggugugcauugccugguccucuagcuccugucaugacggaaaggccuggcuccacgucugcaucacaggcgaugacaagaacgcuaccgccagcuucauuuacaauggccggcugguggauucuguuguguccuggagcaaagagauccuucgcacccaggaaucugagugugucugcauuaacgggacauguacgguggugaucaccgacggauccgcuagcggcaaggccgauacaaaaauccuguuuauugaggaagggaagaucguccauaccuccacacucucuggaagcgcgcaacacguugaggaaugcuccugcuaucccagauacccuggcgugcggugugugugccgcgacaacuggaaggggagcaauagacccauugucgauaucaacauuaaagaccacucuaucguguccagcuacguuuguucuggacuggugggcgacaccccgcggaagaaugauagcuccucuagcucccauugccuugacccuaacaaugaggaaggcgggcacggagucaaaggcugggccuucgaugacgggaacgauguguggaugggacgcacgaucaaugagacaagcagacugggcuaugagaccuuuaagguuauugaaggguggucuaaccccaaauccaagcuccagaucaaucgccaggugauugucgaccggggagauagaagcggcuacucuggcaucuucuccguggaggggaaaagcuguauuaaccggugcuuuuaugucgaacugaucagaggacgcaaggaggaaaccgaggugcuguggacauccaauucuauuguuguguucuguggcaccagcgggacauacggaacgggcuccuggccugacggggcugaucucaaccugaugcccaucuga

SEQ ID NO: 206932 - RNA, 1410 nt, Artificial Sequence
  derived and/or modified sequence opt5 from neuraminidase__InfluenzaA__AGW01418
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccggggugcuguggacauccaauucuaucguuguguucuguggaaccagcggcacauacgggacgggcuccuggccugauggagcugaccucaaccugaugcccauuuga

SEQ ID NO: 206933 - RNA, 1410 nt, Artificial Sequence; identical to SEQ ID NO: 205170
  derived and/or modified sequence opt5 from neuraminidase__InfluenzaA__AGW01430

SEQ ID NO: 206934 - RNA, 1410 nt, Artificial Sequence; identical to SEQ ID NO: 205170
  derived and/or modified sequence opt5 from neuraminidase__InfluenzaA__AGW01442

SEQ ID NO: 206935 - RNA, 1410 nt, Artificial Sequence; identical to SEQ ID NO: 205170
  derived and/or modified sequence opt5 from neuraminidase__InfluenzaA__AGW01454

SEQ ID NO: 206936 - RNA, 1410 nt, Artificial Sequence; identical to SEQ ID NO: 206895
  derived and/or modified sequence opt5 from neuraminidase__InfluenzaA__AGW01466

SEQ ID NO: 206937 - RNA, 1410 nt, Artificial Sequence; identical to SEQ ID NO: 205170
  derived and/or modified sequence opt5 from neuraminidase__InfluenzaA__AGW01478

SEQ ID NO: 206938 - RNA, 1410 nt, Artificial Sequence
  derived and/or modified sequence opt5 from neuraminidase__InfluenzaA__AGW01490
augaaccccaaucagaagaucauuaccaucagcuccgugucucugacaauuagcacgaucugcuucuuuaugcaaauugccauccucaucaccacagucacccugcacuucaaacaguacgaguuuaacuccccuccgaauaaccagguuaugcuuugugaacccacaauuaucgagagaaauauuaccgaaaucguguaucugacaaacaccacgauugagaaggaaaucugcccuaaacccgcugaguaccggaauuggucuaagccucaguguggcauuaccggguucgcccccuuuagcaaagacaacuccauccgccucucugcgggaggcgauaucugggugacaagagagccuuaugucagcugcgacccggauaaguguuaccaauucgcucuggggcagggaaccacacuuaauaacgugcauuccaauaacaccguucgggaccgcacgcccuauagaacacugcucaugaaugaacugggcgugccuuuucaccuggggaccaagcaggucugcauugccuggucuagcuccagcugucaugauggaaaagccuggcuccacgugugcaucacaggcgacgauaagaacgcuaccgccucuuucauuuacaauggccggcugguugacuccguggucagcuggucuaaagagauccuucgcacccaggaauccgagugugugugcauuaacgggacauguacgguggucaugaccgauggaagcgcuuccggcaaggccgacacaaaaauccuguuuaucgaggaagggaagauuguucauaccucuacacucagcggauccgcgcaacacguggaggaaugcagcugcuaucccagauacccuggcgugcggugugucugccgcgauaacuggaaggggucuaauagacccaucguggacauuaacaucaaagaucacuccauuguuagcucuuacguguguagcggacuggucggcgacaccccgcggaagaaugacuccucuagcuccagccauugccuugauccuaacaaugaggaaggcgggcacggagugaaaggcugggccuucgacgaugggaacgacguuuggaugggacgcacgaucaaugagacaucuagacugggcuaugagaccuuuaaggugaucgaagggugguccaacagcaaaucuaagcuccagauuaaucggcaggucaucguggaucgcggagacagauccggcuacagcggcauuuucuccgucgaggggaaaucuuguaucaaccggugcuuuuauguggaacugauuagaggacgcaaggaggaaaccgagguucuguggacaagcaauuccaucguggucuucuguggcaccucugggacauacggaacgggcagcuggcccgauggggcugaccucaaccugaugccuauuuga

SEQ ID NO: 206939 - RNA, 1410 nt, Artificial Sequence; identical to SEQ ID NO: 205170
  derived and/or modified sequence opt5 from neuraminidase__InfluenzaA__AGW01538

SEQ ID NO: 206940 - RNA, 1410 nt, Artificial Sequence; identical to SEQ ID NO: 206895
  derived and/or modified sequence opt5 from neuraminidase__InfluenzaA__AGW01562

SEQ ID NO: 206941 - RNA, 1410 nt, Artificial Sequence; identical to SEQ ID NO: 205170
  derived and/or modified sequence opt5 from neuraminidase__InfluenzaA__AGW01574

SEQ ID NO: 206942 - RNA, 1410 nt, Artificial Sequence; identical to SEQ ID NO: 205170
  derived and/or modified sequence opt5 from neuraminidase__InfluenzaA__AGW01586

SEQ ID NO: 206943 - RNA, 1410 nt, Artificial Sequence; identical to SEQ ID NO: 205170
  derived and/or modified sequence opt5 from neuraminidase__InfluenzaA__AGW01598

SEQ ID NO: 206944 - RNA, 1410 nt, Artificial Sequence; identical to SEQ ID NO: 206895
  derived and/or modified sequence opt5 from neuraminidase__InfluenzaA__AGW01610

SEQ ID NO: 206945 - RNA, 1410 nt, Artificial Sequence; identical to SEQ ID NO: 205170
  derived and/or modified sequence opt5 from neuraminidase__InfluenzaA__AGW01622

SEQ ID NO: 206946 - RNA, 1410 nt, Artificial Sequence; identical to SEQ ID NO: 205170
  derived and/or modified sequence opt5 from neuraminidase__InfluenzaA__AGW01634

SEQ ID NO: 206947 - RNA, 1410 nt, Artificial Sequence
  derived and/or modified sequence opt5 from neuraminidase__InfluenzaA__AGW01646
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauugauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcggcgauagaagcggcuacucugggauuuucuccgucgagggaaaaagcuguaucaaucggugcuuuuauguggaacugauuagaggccgcaaggaggaaaccgagguucuguggacauccaacucuaucguggucuucugugggaccagcggaacauacggcacgggguccuggccugacggcgcugaucucaaucugaugcccauuuga

SEQ ID NO: 206948 - RNA, 1410 nt, Artificial Sequence; identical to SEQ ID NO: 205170
  derived and/or modified sequence opt5 from neuraminidase__InfluenzaA__AGW01670

SEQ ID NO: 206949 - RNA, 1410 nt, Artificial Sequence; identical to SEQ ID NO: 205170
  derived and/or modified sequence opt5 from neuraminidase__InfluenzaA__AGW01682

SEQ ID NO: 206950 - RNA, 1410 nt, Artificial Sequence; identical to SEQ ID NO: 206907
  derived and/or modified sequence opt5 from neuraminidase__InfluenzaA__AGW01704

SEQ ID NO: 206951 - RNA, 1410 nt, Artificial Sequence
  derived and/or modified sequence opt5 from neuraminidase__InfluenzaA__AGW01716
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggacggagcuguaucaacagaugcuuuuaugucgaacugauucgcggccggaaagaggaaaccgaggugcuguggacauccaauucuaucguuguguucugugggaccagcggaacauacggcacgggguccuggccugauggcgcugaccucaaccugaugcccauuuga

SEQ ID NO: 206952 - RNA, 1410 nt, Artificial Sequence
  derived and/or modified sequence opt5 from neuraminidase__InfluenzaA__AGW01728
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacaugcauagcaauaacaccgugcgggaccgcacgcccuauagaacacugcucaugaaugaacuggggguuccuuuucaccugggaaccaaacaggugugcauugccugguccucuagcuccugucaugauggcaaggccuggcuccacgucugcaucacaggcgacgauaagaacgcuaccgccagcuucauuuacaaugggcggcugguggacucuguuguguccuggagcaaagagauccuucgcacccaggaaucugagugugucugcauuaacggaacauguacgguggugaugaccgauggcuccgcuagcgggaaggccgacacaaaaauccuguuuaucgaggaaggaaagauuguccauaccuccacacucucuggcagcgcgcaacacguugaggaaugcuccugcuaucccagauacccuggggugcggugugugugccgcgauaacuggaagggaagcaauagacccaucgucgacauuaacaucaaagaucacucuauuguguccagcuacguuuguucuggccuggugggcgacaccccgcggaagaaugacagcuccucuagcucccauugccuugauccuaacaaugaggaagggggacacggcgucaaagggugggccuucgacgauggaaacgacguguggaugggccgcacgaucaaugagacaagcagacugggguaugagaccuuuaagguuaucgaaggauggucuaaccccaaauccaagcuccagauuaaucgccaggugaucgucgaucggggcgacagaagcggcuacucugggauuuucuccguggagggaaaaagcuguaucaaccggugcuuuuaugucgaacugauuagaggccgcaaggaggaaaccgaggugcuguggacauccaauucuguuguggucuucugugggaccagcggaacauacggcacgggguccuggccugauggcgcugaccucaaccugaugcccaucuga

SEQ ID NO: 206953 - RNA, 1410 nt, Artificial Sequence; identical to SEQ ID NO: 205170
  derived and/or modified sequence opt5 from neuraminidase__InfluenzaA__AGW01740

SEQ ID NO: 206954 - RNA, 1410 nt, Artificial Sequence
  derived and/or modified sequence opt5 from neuraminidase__InfluenzaA__AGW01752
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugaacugggggugccuuuucaccugggaaccaagcaggucugcauugccugguccucuagcuccugucaugauggcaaagccuggcuccacgugugcaucacaggcgacgauaagaacgcuaccgccagcuucauuuacaaugggcggcugguugacucuguggucuccuggagcaaagagauccuucgcacccaggaaucugagugugugugcauuaacggaacauguacgguggucaugaccgauggcuccgcuagcgggaaggccgacacaaaaauccuguuuaucgaggaaggaaagauuguucauaccuccacacucucuggcagcgcgcaacacguggaggaaugcuccugcuaucccagauacccuggggugcggugugucugccgcgauaacuggaagggaagcaauagacccaucguggacauuaacaucaaagaucacucuauuguuuccagcuacguguguucuggccuggucggcgacaccccgcggaagaaugacagcuccucuagcucccauugccuugauccuaacaaugaggaagggggacacggcgugaaagggugggccuucgacgauggaaacgacguuuggaugggccgcacgaucaaugagacaagcagacugggguaugagaccuuuaaggugaucggaggcuggucuaaccccaaauccaagcuccagauuaaucggcaggucaucguggaucgcggcgacagaagcggguacucuggaauuuucuccgucgaaggcaaaagcuguaucaaccggugcuuuuauguggagcugauuagagggcgcaaggaagagaccgaaguucuguggacauccaauucuaucguggucuucuguggaaccagcggcacauacgggacgggcuccuggccugauggagcugaccucaaccugaugcccauuuga

SEQ ID NO: 206955 - RNA, 1410 nt, Artificial Sequence; identical to SEQ ID NO: 205170
  derived and/or modified sequence opt5 from neuraminidase__InfluenzaA__AGW01764

SEQ ID NO: 206956 - RNA, 1410 nt, Artificial Sequence; identical to SEQ ID NO: 206907
  derived and/or modified sequence opt5 from neuraminidase__InfluenzaA__AGW01776

SEQ ID NO: 206957 - RNA, 1410 nt, Artificial Sequence; identical to SEQ ID NO: 206895
  derived and/or modified sequence opt5 from neuraminidase__InfluenzaA__AGW01788

SEQ ID NO: 206958 - RNA, 1410 nt, Artificial Sequence; identical to SEQ ID NO: 206907
  derived and/or modified sequence opt5 from neuraminidase__InfluenzaA__AGW01800

SEQ ID NO: 206959 - RNA, 1410 nt, Artificial Sequence; identical to SEQ ID NO: 206895
  derived and/or modified sequence opt5 from neuraminidase__InfluenzaA__AGW01812

SEQ ID NO: 206960 - RNA, 1410 nt, Artificial Sequence; identical to SEQ ID NO: 206895
  derived and/or modified sequence opt5 from neuraminidase__InfluenzaA__AGW01824

SEQ ID NO: 206961 - RNA, 1410 nt, Artificial Sequence; identical to SEQ ID NO: 206918
  derived and/or modified sequence opt5 from neuraminidase__InfluenzaA__AGW01848

SEQ ID NO: 206962 - RNA, 1410 nt, Artificial Sequence
  derived and/or modified sequence opt5 from neuraminidase__InfluenzaA__AGW01860
augaaccccaaucagaagaucauuaccaucggcagcgugucccugacaauuucuacgaucugcuucuuuaugcaaauugccauccucaucaccacagucacccugcacuucaaacaguacgaguuuaacagccuuccuaauaaccagguuaugcugugugaaccgacaauuaucgagagaaauauuaccgaaaucguguaucucacaaacaccacgauugagaaggaaaucugccccaaaccugcugaguaccggaauugguccaagccccagugugggauuaccggauucgccccuuuuucuaaagacaacagcauccgccuguccgcgggcggggauaucugggugacaagagagcccuaugucucuugcgacccugauaaguguuaccaauucgcucuuggacagggcaccacacugaauaacgugcauagcaauaacaccguucgggaccgcacgccguauagaacacuccugaugaaugaacugggggugcccuuucaccucggaaccaagcaggucugcauugccugguccuccucuuccugucaugauggcaaagccuggcugcacgugugcaucacaggcgacgauaagaacgcuaccgccagcuucauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuauccuagauaccccggggugcggugugucugccgcgauaacuggaagggaagcaauagaccuaucguggacauuaacaucaaagaucacucuauuguuuccagcuacguguguucuggccuugucggcgacacgccccggaagaaugacagcuccucuagcucccauugcuucgauccgaacaaugaggaagggggacacggcgugaaagggugggccuuugacgauggaaacgacguuuggaugggccgcaccaucaaugagacaagcagacugggguaugagaccuucaaggugaucggaggcuggucuaacccuaaauccaagcuccagauuaaucggcaggucaucguggaucgcggcgacagaagcggguacucuggaauuuuuagcgucgaaggcaaaagcuguaucaaccggugcuucuauguggagcugauuagagggcgcaaggaagagaccgaaguucuguggacauccaauucuaucauuguguucuguggaaccagcggcacauacgggacgggcuccuggcccgauggagcugaccucaaccugaugccuaucuga

SEQ ID NO: 206963 - RNA, 1410 nt, Artificial Sequence
  derived and/or modified sequence opt5 from neuraminidase__InfluenzaA__AGW01884
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccaagaucguguaucugacaaacaccacgauugaaaaagagaucugcccuaagcccgcugaauaccggaauugguccaaaccucagugugggauuaccggauucgcccccuuuucuaaggacaacagcauccgccucuccgcgggcggggauaucugggugacaagagagccuuaugucucuugcgacccggauaaguguuaccaauucgcucugggacagggcaccacacuuaauaacgugcauagcaauaacaccguucgggaccgcacgcccuauagaacacugcucaugaaugagcugggggugccuuuucaccugggaaccaaacaggucugcauugccugguccucuagcuccugucaugauggcaaggccuggcuccacgugugcaucacaggcgacgauaaaaacgcuaccgccagcuucauuuacaaugggcggcugguugacucuguggucuccuggagcaaggaaauccuucgcacccaggagucugaaugugugugcauuaacggaacauguacgguggucaugaccgauggcuccgcuagcgggaaagccgacacaaagauccuguuuaucgaggagggaaagauuguucauaccuccacacucucuggcagcgcgcaacacguggaagagugcuccugcuaucccagauacccuggggugcggugugucugccgcgauaacuggaaaggaagcaauagacccaucguggacauuaacaucaaggaucacucuauuguuuccagcuacguguguucuggccuggucggcgacaccccgcggaaaaaugacagcuccucuagcucccauugccuugauccuaacaaugaagaagggggacacggcgugaaggggugggccuucgacgauggaaacgacguuuggaugggccgcacgaucaaugagacaagcagacugggguaugagaccuuuaaagugaucgagggauggucuaaccccaaguccaaacuccagauuaaucggcaggucaucguggaucgcggcgacagaagcggcuacucugggauuuucuccgucgaaggaaagagcuguaucaaccggugcuuuuauguggagcugauuagaggccgcaaggaagagaccgaaguucuguggacauccaauucuaucguggucuucugugggaccagcggaacauacggcacgggguccuggccugauggcgcugaccucaaccugaugcccauuuga

SEQ ID NO: 206964 - RNA, 1410 nt, Artificial Sequence; identical to SEQ ID NO: 205170
  derived and/or modified sequence opt5 from neuraminidase__InfluenzaA__AGW01896

SEQ ID NO: 206965 - RNA, 1410 nt, Artificial Sequence; identical to SEQ ID NO: 205170
  derived and/or modified sequence opt5 from neuraminidase__InfluenzaA__AGW01908

SEQ ID NO: 206966 - RNA, 1410 nt, Artificial Sequence; identical to SEQ ID NO: 205170
  derived and/or modified sequence opt5 from neuraminidase__InfluenzaA__AGW01920

SEQ ID NO: 206967 - RNA, 1410 nt, Artificial Sequence; identical to SEQ ID NO: 205170
  derived and/or modified sequence opt5 from neuraminidase__InfluenzaA__AGW01932

SEQ ID NO: 206968 - RNA, 1410 nt, Artificial Sequence
  derived and/or modified sequence opt5 from neuraminidase__InfluenzaA__AGW01944
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacccgcugaguaccggaauuggagcaagccucagugugggauuaccggauuugcccccuucuccaaagacaacucuauccgccucagcgcgggcggggauaucugggugacaagagagccuuaugucuccugcgacccggauaaguguuaccaauuugcucugggacagggcaccacacuuaauaacgugcauucuaauaacaccguucgggaccgcacgcccuauagaacacugcucaugaaugaacugggggugccuuuccaccugggaaccaagcaggucugcauugccuggagcuccagcucuugucaugauggcaaagccuggcuccacgugugcaucacaggcgacgauaagaacgcuaccgccuccuuuauuuacaaugggcggcugguugacagcguggucucuugguccaaagagauccuucgcacccaggaaagcgagugugugugcauuaacggaacauguacgguggucaugaccgauggcucugcuuccgggaaggccgacacaaaaauccuguucaucgaggaaggaaagauuguucauaccagcacacucuccggcucugcgcaacacguggaggaaugcagcugcuaucccagauacccuggggugcggugugucugccgcgauaacuggaagggauccaauagacccaucguggacauuaacaucaaagaucacagcauuguuucuuccuacguguguagcggccuggucggcgacaccccgcggaagaaugacucuagcuccucuagccauugccuugccccuaacaaugaggaagggggacacggcgugaaagggugggcuuuugaugacggaaacgauguuuggaugggccgcacgaucaaugagacauccagacugggguaugagaccuucaaggugaucgaaggauggagcaaccccaaaucuaagcuccagauuaaucggcaggucaucguggaccgcggcgauagauccggcuacagcgggaucuuuucugucgagggaaaauccuguauuaaccggugcuucuauguggaacugauuagaggccgcaaggaggaaaccgagguucuguggacaagcaauuccaucguggucuucugugggaccucuggaacauacggcacggggagcuggccugacggcgccgaucucaaccugaugcccauuuga

SEQ ID NO: 206969 - RNA, 1410 nt, Artificial Sequence; identical to SEQ ID NO: 205170
  derived and/or modified sequence opt5 from neuraminidase__InfluenzaA__AGW01956

SEQ ID NO: 206970 - RNA, 1410 nt, Artificial Sequence
  derived and/or modified sequence opt5 from neuraminidase__InfluenzaA__AGW01968
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccauucgggaucgcacgcccuauagaacacugcucaugaaugaacugggcguuccuuuucaccuggggaccaaacaggugugcaucgccugguccucuagcuccugucaugacggaaaggccuggcuccacgucugcauuacaggcgaugacgagaacgcuaccgccagcuucaucuacaauggccggcugguggauucuguuguguccuggagcaaggaaauucuucgcacccaggagucugagugugucugcaucaacgggacauguacgguggugaugaccgacggauccgcuagcggcaaagccgauacaaagauccuguuuauugaagaggggaaaaucguccauaccuccacacucucuggaagcgcgcaacacguugaagagugcuccugcuaucccagauacccuggcgugcggugugugugccgcgacaacuggaaggggagcaauagacccauugucgauaucaacauuaaggaccacucuaucgugucccgguacguuuguagcggacuggugggcgacaccccgcgcaaaaaugauucuagcuccucuagccauugccuugacccuaacaaugaagagggcgggcacggagucaagggcugggccuucgaugacgggaacgauguguggaugggaagaacgaucaaugagacaucccggcugggcuaugaaaccuuuaaaguuauugagggguggagcaaccccaagucuaaacuccagaucaaucgccaggugauugucgacagaggagaucgguccggcuacagcggcaucuucucuguggaagggaaguccuguauuaacagaugcuuuuaugucgagcugauccgcggacggaaagaagagaccgaggugcuguggacaagcaauuccauuguuguguucuguggcaccucugggacauacggaacgggcagcuggccugacggggcugaucucaaccugaugcccaucuga

SEQ ID NO: 206971 - RNA, 1410 nt, Artificial Sequence; identical to SEQ ID NO: 206895
  derived and/or modified sequence opt5 from neuraminidase__InfluenzaA__AGW01980

SEQ ID NO: 206972 - RNA, 1410 nt, Artificial Sequence; identical to SEQ ID NO: 205170
  derived and/or modified sequence opt5 from neuraminidase__InfluenzaA__AGW01992

SEQ ID NO: 206973 - RNA, 1410 nt, Artificial Sequence; identical to SEQ ID NO: 205170
  derived and/or modified sequence opt5 from neuraminidase__InfluenzaA__AGW02004

SEQ ID NO: 206974 - RNA, 1410 nt, Artificial Sequence; identical to SEQ ID NO: 205170
  derived and/or modified sequence opt5 from neuraminidase__InfluenzaA__AGW02016

SEQ ID NO: 206975 - RNA, 1410 nt, Artificial Sequence; identical to SEQ ID NO: 205170
  derived and/or modified sequence opt5 from neuraminidase__InfluenzaA__AGW02040

SEQ ID NO: 206976 - RNA, 1410 nt, Artificial Sequence
  derived and/or modified sequence opt5 from neuraminidase__InfluenzaA__AGW02064
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcgggcauugccuugacccuaauaacgaggaaggaggccacggggugaaaggaugggccuucgaugacggcaaugauguuuggauggggcgcacgaucaacgagacauccagacugggauaugagaccuuuaaggugaucgaaggcuggagcaaucccaaaucuaagcuccagauuaaccggcaggucaucguggaccgcggcgauagauccggguacagcggaauuuucucugucgagggcaaauccuguaucaaucggugcuuuuauguggaacugauuagagggcgcaaggaggaaaccgagguucuguggacaagcaacuccaucguggucuucuguggaaccucuggcacauacgggacgggcagcuggccugacggagcugaucucaaucugaugcccauuuga

SEQ ID NO: 206977 - RNA, 1410 nt, Artificial Sequence; identical to SEQ ID NO: 205170
  derived and/or modified sequence opt5 from neuraminidase__InfluenzaA__AGW02076

SEQ ID NO: 206978 - RNA, 1410 nt, Artificial Sequence; identical to SEQ ID NO: 205170
  derived and/or modified sequence opt5 from neuraminidase__InfluenzaA__AGW02088

SEQ ID NO: 206979 - RNA, 1410 nt, Artificial Sequence
  derived and/or modified sequence opt5 from neuraminidase__InfluenzaA__AGW02100
augaaccccaaucagaagaucauuaccaucggcagcgugucccugacaauuucuacgaucugcuucuuuaugcaaauugccauccucaucaccacagucacccugcacuucaaacaguacgagagcaacuccccuccgaauaaccagguuaugcuuugugaacccacaauuaucgagagaaauauuaccgaaaucguguaucugacaaacaccacgauugagaaggaaaucugcccuaaacccgcugaguaccggaauuggucuaagccucagugugggauuaccggauuugcccccuucagcaaagacaacuccauccgccucucugcgggcggggauaucugggugacaagagagccuuaugucagcugcgacccggauaaguguuaccaauuugcucugggacagggcaccacacuuaauaacgugcauuccaauaacaccguucgggaccgcacgcccuauagaacacugcucaugaaugaacugggggugccuuuccaccugggaaccaagcaggucugcauugccuggucuagcuccagcugucaugauggcaaagccuggcuccacgugugcaucacaggcgacgauaagaacgcuaccgccucuuuuauuuacaaugggcggcugguugacuccguggucagcuggucuaaagagauccuucgcacccaggaauccgagugugugugcauuaacggaacauguacgguggucaugaccgauggcagcgcuuccgggaaggccgacacaaaaauccuguucaucgaggaaggaaagauuguucauaccucuacacucagcggcuccgcgcaacacguggaggaaugcagcugcuaucccagauacccuggggugcggugugucugccgcgauaacuggaagggaucuaauagacccaucguggacauuaacaucaaagaucacuccauuguuagcucuuacguguguagcggccuggucggcgacaccccgcggaagaaugacuccucuagcuccagccauugccuugauccuaacaaugaggaagggggacacggcgugaaagggugggccuuugacgauggaaacgacguuuggaugggccgcacgaucaaugagacaucuagacugggguaugagaccuucaaggugaucgaaggaugguccaaccccaaaagcaagcuccagauuaaucggcaggucaucguggaucgcggcgacagaucuggcuacuccgggauuuuuagcgucgagggaaaauccuguaucaaccggugcuucuauguggaacugauuagaggccgcaaggaggaaaccgagguucuguggacaucuaauagcaucguggucuuuugugggaccuccggaacauacggcacggggucuuggccugauggcgcugaccucaaccugaugcccauuuga

SEQ ID NO: 206980 - RNA, 1410 nt, Artificial Sequence; identical to SEQ ID NO: 206907
  derived and/or modified sequence opt5 from neuraminidase__InfluenzaA__AGW02112

SEQ ID NO: 206981 - RNA, 1410 nt, Artificial Sequence
  derived and/or modified sequence opt5 from neuraminidase__InfluenzaA__AGW02124
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugggauuaccggauucgcccccuuuucuaaagacaacagcauccgccucuccgcgggcggggauaucugggugacaagagagccuuaugucucuugcgacccggauaaguguuaccaauucgcucugggacagggcaccacacuuaauaacgugcauagcaauaacaccguuuccgaccggacgcccuaucgcacacugcucaugaaugaacugggggugccuuuucaccugggaaccaagcaggucugcauugccuggucuagcuccagcugucaugauggcaaagccuggcuccacgugugcaucacaggcgacgauaagaacgcuaccgccucuuucauuuacaaugggagacugguugacuccguggucagcuggucuaaagagauccuucggacccaggaauccgagugugugugcauuaacggaacauguacgguggucaugaccgauggcagcgcuuccgggaaggccgacacaaaaauccuguuuaucgaggaaggaaagauuguucauaccucuacacucagcggcuccgcgcaacacguggaggaaugcagcugcuauccccgcuacccuggggugagaugugucugccgggauaacuggaagggaucuaaucgccccaucguggacauuaacaucaaagaucacuccauuguuagcucuuacguguguagcggccuggucggcgacaccccgagaaagaaugacuccucuagcuccagccauugccuugauccuaacaaugaggaagggggacacggcgugaaagggugggccuucgacgauggaaacgacguuuggaugggccggacgaucaaugagacaucucgccugggguaugagaccuuuaaggugaucgaaggaugguccaaccccaaaagcaagcuccagauuaauagacaggucaucguggaucggggcgaccgcucuggcuacuccgggauuuucagcgucgagggaaaauccuguaucaacagaugcuuuuauguggaacugauucggggcagaaaggaggaaaccgagguucuguggacaucuaauagcaucguggucuucugugggaccuccggaacauacggcacggggucuuggccugauggcgcugaccucaaccugaugcccauuuga

SEQ ID NO: 206982 - RNA, 1410 nt, Artificial Sequence; identical to SEQ ID NO: 206895
  derived and/or modified sequence opt5 from neuraminidase__InfluenzaA__AGW02136

SEQ ID NO: 206983 - RNA, 1410 nt, Artificial Sequence; identical to SEQ ID NO: 206907
  derived and/or modified sequence opt5 from neuraminidase__InfluenzaA__AGW02148

SEQ ID NO: 206984 - RNA, 1410 nt, Artificial Sequence
  derived and/or modified sequence opt5 from neuraminidase__InfluenzaA__AGW02160
augaaccccaaucagaagaucauuaccaucggcagcgugucccugacaauuucuacgaucugcuucuuuaugcaaauugccauccucaucaccacagucacccugcacuucaaacaguacgaguuugacagcccuccgaacaaucagguuaugcuuugugaacccacaauuaucgagagaaacauuaccgaaaucguguaucugacaaauaccacgauugagaaggaaaucugcccuaaacccgcugaguaccggaacugguccaagccucagugugggauuaccggauucgcccccuuuucuaaagauaauagcauccgccucuccgcgggcggggacaucugggugacaagagagccuuaugucucuugcgauccggacaaguguuaccaauucgcucugggacagggcaccacacuuaacaaugugcauagcaacaauaccguucgggaucgcacgcccuauagaacacugcucaugaacgaacugggggugccuuuucaccugggaaccaagcaggucugcauugccugguccucuagcuccugucaugacggcaaagccuggcuccacgugugcaucacaggcgaugacaagaaugcuaccgccagcuucauuuacaacgggcggcugguugauucuguggucuccuggagcaaagagauccuucgcacccaggaaucugagugugugugcauuaauggaacauguacgguggucaugaccgacggcuccgcuagcgggaaggccgauacaaaaauccuguuuaucgaggaaggaaagauuguucauaccuccacacucucuggcagcgcgcaacacguggaggaaugcuccugcuaucccagauacccuggggugcggugugucugccgcgacaacuggaagggaagcaacagacccaucguggauauuaauaucaaagaccacucuauuguuuccagcuacguguguucuggccuggucggcgacaccccgcggaagaacgauagcuccucuagcucccauugccuugacccuaauaacgaggaagggggacacggcgugaaagggugggccuucgaugacggaaaugauguuuggaugggccgcacgaucaacgagacaagcagacugggguaugagaccuuuaaggugaucgaaggauggucuaaucccaaauccaagcuccagauuaaccggcaggucaucguggaccgcagcgauagaucuggcuacuccggcauuuucagcgucgaggggaaauccuguaucaaucggugcuuuuauguggaacugauuagaggacgcaaggaggaaaccgagguucuguggacaucuaacagcaucguggucuucuguggcaccuccgggacauacggaacgggcucuuggccugacggggcugaucucaaucugaugcccauuuga

SEQ ID NO: 206985 - RNA, 1410 nt, Artificial Sequence; identical to SEQ ID NO: 205170
  derived and/or modified sequence opt5 from neuraminidase__InfluenzaA__AGW02172

SEQ ID NO: 206986 - RNA, 1410 nt, Artificial Sequence; identical to SEQ ID NO: 205170
  derived and/or modified sequence opt5 from neuraminidase__InfluenzaA__AGW02184

SEQ ID NO: 206987 - RNA, 1410 nt, Artificial Sequence
  derived and/or modified sequence opt5 from neuraminidase__InfluenzaA__AGW02196
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugauuaacacaaccaucgagaaggaaauuugcccuaaacccgcugaguaccggaauugguccaagccucagugugggaucacgggauucgcccccuuuucuaaagacaacagcauccgccucuccgcgggcggggauauuugggugaccagagagccuuaugucucuugcgacccguacaaguguuaucaauucgcucugggacagggcacaacccuuaauaacgugcauagcaauaacacaguucgggaucgcacccccuacagaacgcugcucaugaaugaacugggggugccuuuucaccugggaacaaagcaggucugcaucgccugguccucuagcuccugucaugacggcaaagccuggcuccacgugugcauuaccggcgaugacaagaacgcuacagccagcuucaucuauaaugggcggcugguugauucuguggucuccuggagcaaagagauucuucgcacccaggaaucugagugugugugcaucaacggaaccuguacaguggucaugacggacggcuccgcuagcgggaaggccgauaccaaaauccuguuuauugaggaaggaaagaucguucauacauccacccucucuggcagcgcgcaacacguggaggaaugcuccugcuaccccagauacccuggggugcggugugucugccgcgacaacuggaagggaagcaauagacccauuguggauaucaacauuaaagaccacucuaucguuuccagcuauguguguucuggccuggucggcgauacaccgcggaagaaugacagcuccucuagcucccauugccuugacccuaacaaugaggaagggggacacggcgugaaagggugggccuucgaugacggaaacgauguuuggaugggccgcaccaucaaugagacgagcagacugggguacgagacauuuaaggugauugaaggauggucuaaccccaaauccaagcuccagaucaaucggcaggucauuguggaccgcggcgauagaagcggcuauucugggaucuucuccgucgagggaaaaagcuguauuaaccggugcuuuuacguggaacugaucagaggccgcaaggaggaaaccgagguucuguggaccuccaauucuauuguggucuucugugggacaagcggaaccuauggcacaggguccuggccugacggcgcugaucucaaccugaugcccaucuga

SEQ ID NO: 206988 - RNA, 1410 nt, Artificial Sequence; identical to SEQ ID NO: 206399
  derived and/or modified sequence opt5 from neuraminidase__InfluenzaA__AGW04174

SEQ ID NO: 206989 - RNA, 1410 nt, Artificial Sequence
  derived and/or modified sequence opt5 from neuraminidase__InfluenzaA__AGW25784
augaaccccaaucagaagaucauuaccaucggcagcgugucccugauuaucgccacaauuugcuuccucaugcaaaucgcuauccuggucacgaccguuacacuucacuuuaaacaguacggguauaacucucugccuaauaaccaggugaugcucugugagccgaccauuaucgaaagaaauauuacagagaucguguaccugaccaacacaaccauugaaaaggagaucugccccaaacuugccgaauaucggaauuggagcaagccucaguguaaaauuacgggauucgcgcccuuuuccaaggacaacucuauccgccugagcgcuggcggggauaucugggucaccagagagccuuacguguccugcgaccccuauaaguguuaccaauucgcccucggacagggcacaacccugaauaacaaacauucuaaugauacaguucacgaccggaccccuuaucgcacgcugcucaugaacgagcugggggugccguuucaucuuggaacaaagcaggucugcauugccuggagcuccagcucuugucacgauggcaaggcuuggcugcauaucugcgugaccggccacgacgaaaaugccacagcuuccuucauuuacgaugggaaacucguugacagcaucggaucuugguccaaaaagauucugagaacccaggagagcgaaugugugugcaucaacggcaccuguacagucgugaugacggaugggucugccuccggacgggcggacaccaagauccuuuuuauugaggagggcaaaaucauucacaucagccaacuguccgggucugcccagcauguggaagagugcagcugcuacccccgcuauccuggaauuagaugugucugccgggauaauuggaagggcuccaaccgccccaucguugacaucaacgugaaagauuacagcauuacaucuuccuauguguguagcggccucgucggggacaccccuagaaagacagacaauucuagcuccucucacugccugaaccccaauaacgaagagggaggccauggggugaaaggaugggcuuucgaugacggcaaugauguuuggauggggcggaccaucagcgaaaaguuucgcuccggauacgagacguucaaagugauuaagggcuggagcaagccgaacucuaaacugcagaucaauagacaggucauuguggaccgggauaaccgcuccggcuauagcgggaucuuuucuguugagggaaaguccuguauuaauagaugcuucuacguggaacucauccggggcagaaaacgcgaggccgaagucugguggacaagcaacuccaucguggucuuuugugggaccucuggaaccuauggcacagggagcuggccugacggcgcugauauuaaucugaugcccaucuga

SEQ ID NO: 206990 - RNA, 1350 nt, Artificial Sequence
  derived and/or modified sequence opt5 from neuraminidase__InfluenzaA__AGW27062
augaaccccaaucagaagaucgugaccauuggcagcaucugcauggucauugggacaaucucccugaugcuccaaauuggaaacaucaucucuauuuggguuagccacuccauccagacgggcaaucagcaucagaccgagccuauuagaaacacaaauuuccugaccgaaaacgccguggcuucugugacacuugccgggaauagcucccuguguccgauccggggaugggcgguccacucuaaagacaacagcauucgcaucggcuccaagggggauguguuuguuauuagagagcccuucaucagcugcucucaucucgaaugucggaccuuuuuccugacacaaggagcccuucugaaugacaaacacuccaacggcaccgugaaggaucgcagcccucauagaacgcucaugucuugccccaucggcgaggcuccuucccccuacaauagccgguuugaaucugucgccugguccgcuagcgccugucacgacgggaccuccuggcuggugauuggaaucucuggcccugauaacggggcuguugccgugcugaaauauaauggaauuaucacagacaccauucgcagcuggagaaacaauauccuccggacacaggaguccgagugcgcgugugucaacggcagcugcuucaccgugaugacggaugggccgucuaacggacaggccuccuacaagaucuuuaagauugaaaaaggcaagguggucaaaagcguugagcugaaugcucccaacuaucacuacgaagaguguucuugcuauccugacgccggcgagaucacaugugugugccgcgauaauuggcaugggagcaacagacccuggguguccuucaaucagaaccuugaauaccaaauuggauauaucugcucuggcgucuuuggggacaauccucggcccaacgauggaaccggcagcugugggccgguguccagcaauggagcuuacggcguuaagggcuucucuuuuaaauacgggaacggaguguggauuggccgcacaaaguccacccacagcagaucuggguucgagaugaucugggacccuaauggauggaccggcacagauuccgaauuuagcaugaagcaggacaucgucgccauuacggacugguccggguauucuggcagcuucgugcagcaucccgagcugaccggacucgauugcauccggccuuguuucuggguugaacugauucgcggcagacccaaagaguccacaaucuggaccucugggagcuccauuagcuuuugcggagugaacucugacacagucuccuggagcuggcccgauggcgcggagcuuccuuucaccaucgacaaguga

SEQ ID NO: 206991 - RNA, 1410 nt, Artificial Sequence
  derived and/or modified sequence opt5 from neuraminidase__InfluenzaA__AGY14472
augaaccccaaucagaagaucauuaccaucggcagcguuucccugacacucgccacgauuugcuuccugaugcaaaucgcuauucuugucaccacaguuacccugcacuuuaaacaguacgaguguaacucuacaccuaauaaccaggugaugcucugcgaaccgaccgugaucgagagaaauaucacaaagauugucuaucugaccaacacgaccguggaaaaagagaucugucccaagccugccgaauaccggaauuggagcaaaccccagugcaagauuacaggguucgcgccuuuuuccaaggacaacucuauccgccuuagcgcuggaggcgauauuuggguuaccagagagcccuauguguccugugacccuaauaaaugcuaccaauucgcccuggggcagggaacaacccucaacaaucggcauucuaacgauacgguccacgaccgcacaccguauagaacccugcugaugaaugagcucggcauccccuuucaucuggggacaaaacagguguguauugccuggagcuccagcucuugccacgauggaaaggcuuggcuucauguuugugugaccggccacgacaagaacgccaccgcuuccuucaucuacgauggcaaacuggucgacagcaucgggucuugguccaagaagauucuccggacacaggaaagcgagugcguguguaucaauggaacgugcaccguggucaugacagauggcucugccuccgggcgcgcggacaccaaaauucuguuuaucgaagagggaaagauuauccacaucagccaacuuuccggcucugcccagcauguugaggaaugcagcuguuauccuagauaccccgggauucggugcgugugucgcgauaacuggaaaggauccaacagaccuaucguggacauuaaugucaaggauuacagcaucacaucuuccuaugugugcagcggccugguuggcgacacgccccggaaaaccgacaacucuagcuccucucacugucucaauccgaacaaugaggaagggggacauggcgugaaggggugggcuuucgaugacggaaacgaugucuggaugggccgcacaauuagcgagaaauuuagauccggguacgaaaccuucaaggugaucaagggauggagcaaaccuaauucuaagcugcagaucaaccggcagguuauuguggaccgcgauaauagauccggcuauagcggcaucuuuucugucgaggggaaauccugcauuaaccgguguuucuacguggagcugaucagaggacgcaagcgggaagccgaggucugguggaccagcaauuccauugugguguuuugcggcacaucugggaccuauggaacaggcagcuggcccgacggggcugauaucaaccucaugccuauuuga

SEQ ID NO: 206992 - RNA, 1398 nt, Artificial Sequence
  derived and/or modified sequence opt5 from neuraminidase__InfluenzaA__AHA11501
augaaccccaaucagaagauccugugcaccagcgccacagcuauuaucauuggcgccaucgcggugcucauugggaucgcuaaccugggacuuaauaucggccugcaccucaaaccuggguguaacugcucccauucucaaccggagacgaccaauacaagccagaccauuaucaacaauuacuauaacgaaacaaauauuaccaacauccagauggaggaaagaacaucccggaauuucaacaaucugaccaagggacuuuguacgauuaacucuuggcacaucuacggcaaagacaaugccguccgcauuggggagagcuccgauguucuggugaccagagaacccuaugugucuugcgacccugaugagugucgguuuuacgcccucagccagggaacaaccauccgcggcaagcauuccaacggcacaauccacgacagaagccaauaucgggcucugauuucuuggccccuguccagcccucccaccgucuacaacucucgcguggagugcaucgggugguccagcacgucuugucaugauggaaaauccagaaugagcauuugcaucuccggcccuaauaacaaugccucugcuguugugugguauaaccggcgcccggucgccgaaauuaauacaugggcgagaaacauccuccggacccaggagagcgaaugugugugccacaaugggguuugucccaucguguucacagacggauccgccaccggcccugcugauacccgcauuuacuacuuuaaggaggggaagauccuggagugggaaagccuuacaggaacggccaaacacauugaggaaugcucuugcuauggcgagagaaccggcaucacauguaccugccgggacaacuggcagggguccaaucgccccgucauucagaucgauccuguggcuaugacacauaccagccaauacaucuguucucccgugcugacggacacaccgagaccuaacgaucccaauauuggaaagugcaacgacccuuaucccggcaaugauaacaauggggucaaaggauucagcuaccucgacggcgccaacaccuggcuggggcggaccaucuccacagcgucuagaagcggauaugaaaugcuuaagguucccaacgcccugaccgacgaucgcuccaaaccuauucagggccagacaaucgugcucaaugcugacuggagcggcuacucuggguccuuuauggauuauugggccgagggagacuguuaccgggcuugcuucuacguggagcugauuagaggccgcccgaaggaagauaaggucugguggacgagcaacucuaucguguccauguguagcuccaccgaguuucuggggcaguggaauuggcccgacggagcccggauugaauauuuccucuga

SEQ ID NO: 206993 - RNA, 1410 nt, Artificial Sequence
  derived and/or modified sequence opt5 from neuraminidase__InfluenzaA__AHC57462
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugcugggacccgaacaaugaggaaggcgggcacggagugaaaggcugggccuucgaugacgggaacgauguuuggaugggacgcaccaucaaugagacaagcagacugggcuaugagaccuuuaaggugaucgaaggguggucuaacccuaaauccaagcuccaggucaaucgccaggugauugucgaccggggagauagaagcggcuacucuggcaucuucuccguggaggggaaaagcuguauuaaccggugcuuuuauguugaacugaucagaggacgcaaggaggaaaccgaggugcuguggacauccaauucuauugucguguucuguggcaccagcgggacauacggaacgggcuccuggcccgacggggcugaucucaaccugaugccuaucuga

SEQ ID NO: 206994 - RNA, 1410 nt, Artificial Sequence; identical to SEQ ID NO: 202542
  derived and/or modified sequence opt5 from neuraminidase__InfluenzaA__AHC57490

SEQ ID NO: 206995 - RNA, 1410 nt, Artificial Sequence
  derived and/or modified sequence opt5 from neuraminidase__InfluenzaA__AHC57514
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccucuagcuccugucaugacggaaaagccuggcugcacgugugcaucacaggcgaugacaagaaugcuaccgccagcuucauuuauaacggccggcuuguugauucuguggucuccuggagcaaagagauccugcgcacccaggaaucugagugugugugcauuaaugggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuacccuagauaccccggcgugcggugugucugccgcgacaacuggaaggggagcaacagaccuaucguggauauuaauaucaaagaccacucuauuguuuccagcuauguguguucuggacuugucggcgacacgccccggaagaacgauagcuccucuagcucccauugccuggacccgaauaacgaggaaggcgggcacggagugaaaggcugggccuucgaugacgggaaugauguuuggaugggacgcaccaucaacgagacaagcagacucggcuacgagaccuuuaaggugaucgaaggguggucuaauccuaaauccaagcugcagauuaaccggcaggucaucguggaccgcggaaauagaagcggcuauucuggcauuuucuccgucgaggggaaaagcuguaucaaccggugcuuuuacguggaacugauuagaggacgcaaggaggaaaccgagguucucuggacauccaauucuaucguggucuucuguggcaccagcgggacauauggaacgggcuccuggcccgauggggcugaccugaaccuuaugccuauuuga

SEQ ID NO: 206996 - RNA, 1410 nt, Artificial Sequence; identical to SEQ ID NO: 206995
  derived and/or modified sequence opt5 from neuraminidase__InfluenzaA__AHC57526

SEQ ID NO: 206997 - RNA, 1410 nt, Artificial Sequence; identical to SEQ ID NO: 206995
  derived and/or modified sequence opt5 from neuraminidase__InfluenzaA__AHC57806

SEQ ID NO: 206998 - RNA, 1410 nt, Artificial Sequence; identical to SEQ ID NO: 206995
  derived and/or modified sequence opt5 from neuraminidase__InfluenzaA__AHC57818

SEQ ID NO: 206999 - RNA, 1410 nt, Artificial Sequence
  derived and/or modified sequence opt5 from neuraminidase__InfluenzaA__AHC57830
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcgggcacggagugaagggcugggccuucgacgaugggaaugacguuuggaugggacggacgaucaacgagacaagccgccucggcuaugagaccuuuaaagugaucgaaggguggucuaauccuaaguccaaacugcagauuaacagacaggucaucguggaucggggaaaucgcagcggcuacucuggcauuuucuccgucgaggggaaaagcuguaucaacagaugcuuuuauguggaacugauucggggaagaaaggaggaaaccgagguucucuggacauccaauucuaucguggucuucuguggcaccagcgggacauacggaacgggcuccuggcccgacggggcugaucugaaccuuaugccuauuuga

SEQ ID NO: 207000 - RNA, 1410 nt, Artificial Sequence; identical to SEQ ID NO: 206999
  derived and/or modified sequence opt5 from neuraminidase__InfluenzaA__AHC57971

SEQ ID NO: 207001 - RNA, 1410 nt, Artificial Sequence; identical to SEQ ID NO: 206995
  derived and/or modified sequence opt5 from neuraminidase__InfluenzaA__AHC57984

SEQ ID NO: 207002 - RNA, 1410 nt, Artificial Sequence
  derived and/or modified sequence opt5 from neuraminidase__InfluenzaA__AHC57996
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccgcacagaacacuccugaugaacgaacugggcgugcccuuucaucucgggaccaagcaggucugcauugccugguccucuagcuccugucacgacggaaaagccuggcugcaugugugcaucacaggcgaugacaagaaugcuaccgccagcuucauuuacaacggccggcuuguugauucuguggucuccuggagcaaagagauccugcgcacccaggaaucugagugugugugcauuaaugggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccuagauaccccggcgugcggugugucugccgcgacaacuggaaggggagcaacagaccuaucguggauauuaauaucaaagaccauucuauuguuuccagcuacguguguucuggacuugucggcgacacgccccggaagaacgauagcuccucuagcucccacugccuggacccgaauaacgaggaaggcgggcauggagugaaaggcugggccuucgaugacgggaaugauguuuggaugggacgcaccaucaacgagacaagcagacucggcuaugagaccuuuaaggugaucgaaggguggucuaauccuaaauccaagcugcagauuaaccggcaggucaucguggaccgcggaaauagaagcggcuacucuggcauuuucuccgucgaggggaaaagcuguaucaaccggugcuuuuauguggaacugauuagaggacgcaaggaggaaaccgagguucucuggacauccaauucuaucguggucuucuguggcaccagcgggacauacggaacgggcuccuggcccgauggggcugaccugaaccuuaugccuauuuga

SEQ ID NO: 207003 - RNA, 1410 nt, Artificial Sequence; identical to SEQ ID NO: 205946
  derived and/or modified sequence opt5 from neuraminidase__InfluenzaA__AHC58008

SEQ ID NO: 207004 - RNA, 1410 nt, Artificial Sequence; identical to SEQ ID NO: 202542
  derived and/or modified sequence opt5 from neuraminidase__InfluenzaA__AHC58020

SEQ ID NO: 207005 - RNA, 1410 nt, Artificial Sequence
  derived and/or modified sequence opt5 from neuraminidase__InfluenzaA__AHC58032
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccugaauccgaacaaugaggaaggcgggcacggagugaagggcugggccuucgaugacgggaacgauguuuggaugggacggacgaucaaugagacaagccgccucggcuaugagaccuuuaaagugaucgaaggguggucuaacccuaaguccaaacugcagauuaauagacaggucaucguggaccggggaaaccgcagcggcuacucuggcauuuucuccgucgaggggaaaagcuguaucaauagaugcuuuuauguggaacugauucggggaagaaaggaggaaaccgagguucucuggacauccaacucuaucguggucuucuguggcaccagcgggacauacggaacgggcuccuggcccgauggggcugaccugaaucuuaugccuauuuga

SEQ ID NO: 207006 - RNA, 1410 nt, Artificial Sequence; identical to SEQ ID NO: 205946
  derived and/or modified sequence opt5 from neuraminidase__InfluenzaA__AHC58053

SEQ ID NO: 207007 - RNA, 1410 nt, Artificial Sequence
  derived and/or modified sequence opt5 from neuraminidase__InfluenzaA__AHC58077
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuagagaacccacaauuaucgagcggaacauuaccgaaaucguguaccugacaaauaccacgaccgagaaggaaauuuguccuaaacucgcugaguaucgcaacugguccaagccccagugcgacaucacaggguucgccccuuuuucuaaagauaauagcauuagacuguccgcgggaggcgacaucugggugacccgggagcccuacgucucuugugauccugacaagugcuaucaauucgcucuugggcagggaacaacccugaacaaugugcauagcaacaauacgguucgcgauagaacaccguaccggacccuccugaugaacgaacugggcgugcccuuucaccucgggacaaagcaggucuguaucgccugguccucuagcuccugccaugacggaaaagccuggcugcacguguguauuaccggcgaugacaagaaugcuaccgccagcuucaucuauaacggccgccuuguugauucuguggucuccuggagcaaagagauucugagaacacaggaaucugagugcguguguaucaaugggacgugcaccguggucaugacagacggauccgcuagcggcaaggccgauaccaaaauucucuuuaucgaggaagggaagaucguucauacauccacccugucuggaagcgcgcaacacguggaggaauguuccugcuacccucgguaccccggcgugcgcugcgucuguagagacaacuggaaggggagcaaccggccuauuguggauaucaauauuaaagaccacucuaucguuuccagcuaugugugcucuggacuugucggcgacacgccccgcaagaacgauagcuccucuagcucccauugucuggacccgaauaacgaggaaggcgggcacggagugaaaggcugggccuucgaugacgggaaugauguuuggaugggaagaacaauuaacgagaccagccggcucggcuacgagaccuuuaaggugaucgaaggguggucuaauccuaaauccaagcugcagaucaaccgccaggucauuguggacagaggaaaucggagcggcuauucuggcaucuucuccgucgaggggaaaagcugcauuaacagauguuuuuacguggaacugauccgcggacggaaggaggaaacagagguucucuggaccuccaauucuauuguggucuucugcggcacaagcgggacguauggaaccggcuccuggcccgauggggcugaccugaaccuuaugccuaucuga

SEQ ID NO: 207008 - RNA, 1410 nt, Artificial Sequence; identical to SEQ ID NO: 206999
  derived and/or modified sequence opt5 from neuraminidase__InfluenzaA__AHC58089

SEQ ID NO: 207009 - RNA, 1410 nt, Artificial Sequence; identical to SEQ ID NO: 206995
  derived and/or modified sequence opt5 from neuraminidase__InfluenzaA__AHC58101

SEQ ID NO: 207010 - RNA, 1410 nt, Artificial Sequence
  derived and/or modified sequence opt5 from neuraminidase__InfluenzaA__AHC58113
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccagcagcuccugucaugacggaaaagccuggcugcacgugugcaucacaggcgaugacaagaaugcuaccgccagcuucauuuauaacggccggcuuguugauucuguggucuccuggagcaaaaagauccugcgcacccaggagucugaaugugugugcauuaaugggacauguacgguggucaugaccgacggauccgcuagcggcaaagccgauacaaagauccucuuuaucgaggaggggaagauuguucauaccuccacacugucuggaagcgcgcaacacguggaagagugcuccugcuacccuagauaccccggcgugcggugugucugccgcgacaacuggaaagggagcaacagaccuaucguggauauuaauaucaaggaccacucuauuguuuccagcuauguguguucuggacuugucggcgacacgccccggaaaaacgauagcuccucuagcucccauugccuggacccgaauaacgaagagggcgggcacggagugaagggcugggccuucgaugacgggaaugauguuuggaugggacgcaccaucaacgaaacaagcagacucggcuacgagaccuuuaaagugaucgagggguggucuaauccuaaguccaaacugcagauuaaccggcaggucaucguggaccgcggaaauagaagcggcuauucuggcauuuucuccgucgaagggaagucuuguaucaaccggugcuuuuacguggagcugauuagaggacgcaaggaagagaccgaaguucucuggacauccaauucuaucguggucuucuguggcaccagcgggacauauggaacgggcuccuggcccgauggggcugaccugaaccuuaugccuauuuga

SEQ ID NO: 207011 - RNA, 1410 nt, Artificial Sequence; identical to SEQ ID NO: 206995
  derived and/or modified sequence opt5 from neuraminidase__InfluenzaA__AHC58129

SEQ ID NO: 207012 - RNA, 1410 nt, Artificial Sequence; identical to SEQ ID NO: 206995
  derived and/or modified sequence opt5 from neuraminidase__InfluenzaA__AHC58153

SEQ ID NO: 207013 - RNA, 1410 nt, Artificial Sequence; identical to SEQ ID NO: 206995
  derived and/or modified sequence opt5 from neuraminidase__InfluenzaA__AHC58165

SEQ ID NO: 207014 - RNA, 1410 nt, Artificial Sequence; identical to SEQ ID NO: 206999
  derived and/or modified sequence opt5 from neuraminidase__InfluenzaA__AHC58177

SEQ ID NO: 207015 - RNA, 1410 nt, Artificial Sequence
  derived and/or modified sequence opt5 from neuraminidase__InfluenzaA__AHC58189
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagaugagcagacugggcuaugagacauuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggaccuccaauucuaucguggucuucuguggcacaagcgggaccuacggaacaggcuccuggccugacggggcugaucucaaccugaugcccauuuga

SEQ ID NO: 207016 - RNA, 1410 nt, Artificial Sequence; identical to SEQ ID NO: 206995
  derived and/or modified sequence opt5 from neuraminidase__InfluenzaA__AHC58201

SEQ ID NO: 207017 - RNA, 1410 nt, Artificial Sequence
  derived and/or modified sequence opt5 from neuraminidase__InfluenzaA__AHC58225
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucgugaaccgcggagacagaagcggcuacucuggcauuuucuccgucgaggggaaaagcuguaucaaucggugcuuuuauguggaacugauuagaggacgcaaggaggaaaccgagguucuguggacauccaacucuaucguggucuucuguggcaccagcgggacauacggaacgggcuccuggccugauggggcugaccucaaucugaugcccauuuga

SEQ ID NO: 207018 - RNA, 1410 nt, Artificial Sequence; identical to SEQ ID NO: 206999
  derived and/or modified sequence opt5 from neuraminidase__InfluenzaA__AHC58237

SEQ ID NO: 207019 - RNA, 1410 nt, Artificial Sequence; identical to SEQ ID NO: 206995
  derived and/or modified sequence opt5 from neuraminidase__InfluenzaA__AHC58249

SEQ ID NO: 207020 - RNA, 1410 nt, Artificial Sequence; identical to SEQ ID NO: 202542
  derived and/or modified sequence opt5 from neuraminidase__InfluenzaA__AHC58273

SEQ ID NO: 207021 - RNA, 1410 nt, Artificial Sequence; identical to SEQ ID NO: 206999
  derived and/or modified sequence opt5 from neuraminidase__InfluenzaA__AHC58363

SEQ ID NO: 207022 - RNA, 1410 nt, Artificial Sequence; identical to SEQ ID NO: 205946
  derived and/or modified sequence opt5 from neuraminidase__InfluenzaA__AHC58375

SEQ ID NO: 207023 - RNA, 1410 nt, Artificial Sequence; identical to SEQ ID NO: 206999
  derived and/or modified sequence opt5 from neuraminidase__InfluenzaA__AHC58387

SEQ ID NO: 207024 - RNA, 1410 nt, Artificial Sequence; identical to SEQ ID NO: 206999
  derived and/or modified sequence opt5 from neuraminidase__InfluenzaA__AHC58399

SEQ ID NO: 207025 - RNA, 1410 nt, Artificial Sequence; identical to SEQ ID NO: 206995
  derived and/or modified sequence opt5 from neuraminidase__InfluenzaA__AHC58411

SEQ ID NO: 207026 - RNA, 1410 nt, Artificial Sequence; identical to SEQ ID NO: 205946
  derived and/or modified sequence opt5 from neuraminidase__InfluenzaA__AHC58423

SEQ ID NO: 207027 - RNA, 1410 nt, Artificial Sequence; identical to SEQ ID NO: 206999
  derived and/or modified sequence opt5 from neuraminidase__InfluenzaA__AHC58459

SEQ ID NO: 207028 - RNA, 1410 nt, Artificial Sequence
  derived and/or modified sequence opt5 from neuraminidase__InfluenzaA__AHC58471
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagccuguggucagcgugaaacuugcgggaaauuccucucugugcccgguuagcggcugggcuauuuacuccaaggacaacagcaucagaaucgggucuaaaggagauguguuugucauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggaggugcccucuccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccgugaugacggauggacccuccgacggccaggccagcuacaaaauuuuucgcaucgaaaagggcaaaaucgucaagucuguugagaugaaugcuccuaacuaucauuacgaagagugcagcuguuaccccgauuccucugagauuacaugcgugugcagagacaauuggcacggggccaaccggccuugggugagcuucaaucagaaccuggaauaucagaucggauacauuuguuccggcgucuuuggggauaauccccgcccgaacgacaaaaccggaagcugcggcccugugucuuccaauggggcuaacggaguuaagggcuucagcuuuaaguauggcaacgggguguggaucggaagaacaaaaucuauuuccagccggaauggcuucgagaugaucugggaucccaacggguggaccggaaccgacaauaacuuuuccauuaagcaagacaucgucggcaucaaugaauggucuggguacagcggcuccuucgugcagcauccugagcuuacaggacuggauuguauucgccccugcuucuggguugaacucaucagaggccggcccaaagagaacacgauuuggaccucugggagcuccaucagcuuuuguggagucaauucugacacagugggcugguccuggccugauggggccgagcugccguucaccauugacaaguga

SEQ ID NO: 207029 - RNA, 1410 nt, Artificial Sequence; identical to SEQ ID NO: 206995
  derived and/or modified sequence opt5 from neuraminidase__InfluenzaA__AHC58482

SEQ ID NO: 207030 - RNA, 1410 nt, Artificial Sequence; identical to SEQ ID NO: 206999
  derived and/or modified sequence opt5 from neuraminidase__InfluenzaA__AHC58494

SEQ ID NO: 207031 - RNA, 1410 nt, Artificial Sequence
  derived and/or modified sequence opt5 from neuraminidase__InfluenzaA__AHC58518
augaaccccaaucagaagaucauuaccaucggcagcgugucccugacaauuucuacgaucugcuucuuuaugcaagucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccagcagcuccugucaugacggaaaagccuggcugcacguuugcauuacaggcgaugacaagaacgcuaccgccagcuucaucuacaauggcaaacuuguggauucugucguguccuggagcaaggagauucugcggacccaggaaucugagugugugugcaucaacgggacauguacggucguuaugaccgacggauccgcuagcggcaaagccgauacaaagauucucuuuaucgaggaagggaagaucgugcauaccuccacacugucuggaagcgcgcaacacguggaggaaugcuccugcuauccucgcuaccccggcgucagaugugugugccgggacaacuggaaagggagcaaucgcccuauuguugauaucaacauuaaggaccacucuaucguguccagcuacgucuguucuggacuugugggcgacacccccagaaagaaugauagcuccucuagcucccauugccuggacccgaacaaugaggaaggcgggcacggaguuaagggcugggccuucgaugacgggaacgauguguggaugggacggacgauuaaugagacaagccgccucggcuaugagaccuuuaaagucaucgaaggguggucuaacccuaaguccaaacugcagaucaauagacaggugauugucgaccggggaaaccgcagcggcuacucuggcaucuucuccguggaggggaagucuuguauuaauagaugcuuuuauguugaacugauccggggaagaaaggaggaaaccgaggugcucuggacauccaacucuauugucguguucuguggcaccagcgggacauacggaacgggcuccuggcccgauggggcugaccugaaucuuaugccuaucuga

SEQ ID NO: 207032 - RNA, 1410 nt, Artificial Sequence; identical to SEQ ID NO: 206995
  derived and/or modified sequence opt5 from neuraminidase__InfluenzaA__AHC58530

SEQ ID NO: 207033 - RNA, 1410 nt, Artificial Sequence; identical to SEQ ID NO: 206995
  derived and/or modified sequence opt5 from neuraminidase__InfluenzaA__AHC58554

SEQ ID NO: 207034 - RNA, 1410 nt, Artificial Sequence; identical to SEQ ID NO: 206995
  derived and/or modified sequence opt5 from neuraminidase__InfluenzaA__AHC58566

SEQ ID NO: 207035 - RNA, 1410 nt, Artificial Sequence
  derived and/or modified sequence opt5 from neuraminidase__InfluenzaA__AHC58578
augaaccccaaucagaagaucauuaccaucggcagcgugucccugacagucucuacgauuugcuucuuuaugcaaaucgccauucucaucaccacaguuacccugcacuucaaacaguacgaguuuuauagcccuccgaacaaucaggugaugcuuugugaacccacaaucauugagagaaacaucaccgaaauuguguaccugacaaauaccacgaucgagaaggaaauuugcccuaaacucgcugaguaucggaacugguccaagccccagugugacaucaccggguucgccccuuuuucuaaagauaauagcauucgccuguccgcgggaggcgacaucugggucacaagagagcccuacgugucuugcgauccugacaaguguuaucaauucgcucuugggcagggaaccacacugaacaauguucauagcaacaauaccgugcgggaucgcacgccguacagaacacuccugaugaacgaacugggcguccccuuucaccucgggaccaaacaggugugcaucgccugguccucuagcuccugucaugacggaaaggccuggcugcacguuugcauuacaggcgaugacaagaaugcuaccgccagcuucaucuauaacggccggcuuguggauucugucguguccuggagcaaagagauucugcgcacccaggaaucugagugugugugcaucaaugggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuacccuagauaccccggcguccggugugugugccgcgacaacuggaaggggagcaacagaccuauuguugauaucaauauuaaagaccacucuaucguguccagcuaugucuguucuggacuugugggcgacacgccccggaagaacgauagcuccucuagcucccauugccuggacccgaauaacgaggaaggcgggcacggaguuaaaggcugggccuucgaugacgggaaugauguguggaugggacgcaccauuaacgagacaagcagacucggcuacgagaccuuuaaggucaucgaaggguggucuaauccuaaauccaagcugcagaucaaccgccaggugauugucgaccggggaaauagaagcggcuauucuggcaucuucuccguggaggggaaaagcuguauuaaccggugcuuuuacguugaacugaucagaggacgcaaggaggaaaccgaggugcucuggacauccaauucuauugucguguucuguggcaccagcgggacauauggaacgggcuccuggcccgauggggcugaccugaaccuuaugccuaucuga

SEQ ID NO: 207036 - RNA, 1410 nt, Artificial Sequence; identical to SEQ ID NO: 202542
  derived and/or modified sequence opt5 from neuraminidase__InfluenzaA__AHC58590

SEQ ID NO: 207037 - RNA, 1410 nt, Artificial Sequence; identical to SEQ ID NO: 207031
  derived and/or modified sequence opt5 from neuraminidase__InfluenzaA__AHC58602

SEQ ID NO: 207038 - RNA, 1410 nt, Artificial Sequence; identical to SEQ ID NO: 206995
  derived and/or modified sequence opt5 from neuraminidase__InfluenzaA__AHC58614

SEQ ID NO: 207039 - RNA, 1410 nt, Artificial Sequence; identical to SEQ ID NO: 206995
  derived and/or modified sequence opt5 from neuraminidase__InfluenzaA__AHC58626

SEQ ID NO: 207040 - RNA, 1410 nt, Artificial Sequence; identical to SEQ ID NO: 206995
  derived and/or modified sequence opt5 from neuraminidase__InfluenzaA__AHC58638

SEQ ID NO: 207041 - RNA, 1410 nt, Artificial Sequence; identical to SEQ ID NO: 206995
  derived and/or modified sequence opt5 from neuraminidase__InfluenzaA__AHC58650

SEQ ID NO: 207042 - RNA, 1410 nt, Artificial Sequence
  derived and/or modified sequence opt5 from neuraminidase__InfluenzaA__AHC58662
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggcaaacuuguugauucuguggucuccuggagcaaggagauucugcggacacaggaaucugagugugugugcaucaacgggacguguaccguggucaugacagacggauccgcuagcggcaaagccgauaccaagauucucuuuaucgaggaagggaagaucguucauacauccacccugucuggaagcgcgcaacacguggaggaaugcuccugcuauccucgcuaccccggcgugagaugugucugccgggacaacuggaaagggagcaaucgcccuauuguggauaucaacauuaaggaccacucuaucguuuccagcuacguguguucuggacuugucggcgacacgcccagaaagaaugauagcuccucuagcucccauugccuggacccgaacaaugaggaaggcgggcacggagugaagggcugggccuucgaugacgggaacgauguuuggaugggacggacaauuaaugagaccagccgccucggcuaugagaccuuuaaagugaucgaaggguggucuaacccuaaguccaaacugcagaucaauagacaggucauuguggaccggggaaaccgcagcggcuacucuggcaucuucuccgucgaggggaaaagcuguauuaauagaugcuuuuauguggaacugauccggggaagaaaggaggaaacagagguucucuggaccuccaacucuauuguggucuucuguggcacaagcgggacguacggaaccggcuccuggcccgauggggcugaccugaaucuuaugccuaucuga

SEQ ID NO: 207043 - RNA, 1410 nt, Artificial Sequence
  derived and/or modified sequence opt5 from neuraminidase__InfluenzaA__AHC58686
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcauugccugguccucuagcuccugucaugacggaaaggccuggcuccacguuugcaucacaggcgaugacaagaacgcuaccgccagcuucauuuacaauggccggcugguggauucugucguguccuggagcaaagagauccuucgcacccaggaaucugagugugugugcauuaacgggacauguacggucguuaugaccgacggauccgcuagcggcaaggccgauacaaaaauccuguuuaucgaggaagggaagauugugcauaccuccacacucucuggaagcgcgcaacacguggaggaaugcuccugcuaucccagauacccuggcguccggugugugugccgcgacaacuggaaggggagcaauagacccaucguugauauuaacaucaaagaccacucuauuguguccagcuacgucuguucuggacuggugggcgacaccccgcggaagaaugauagcuccucuagcucccauugccuugacccuaacaaugaggaaggcgggcacggaguuaaaggcugggccuucgaugacgggaacgauguguggaugggacgcacgaucaaugagacaagcagacugggcuaugagaccuuuaaggucaucgaaggguggucuaaccccaaauccaagcuccagauuaaucgccaggugaucgucgaccggggagauagaagcggcuacucuggcauuuucuccguggaggggaaaagcuguaucaaccggugcuuuuauguugaacugauuagaggacgcaaggaggaaaccgaggugcuguggacauccaauucuaucgucguguucuguggcaccagcgggacauacggaacgggcuccuggccugacggggcugaucucaaccugaugcccauuuga

SEQ ID NO: 207044 - RNA, 1410 nt, Artificial Sequence
  derived and/or modified sequence opt5 from neuraminidase__InfluenzaA__AHC58698
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacaugugcuguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucaaugagacgagcagacucggcuaugagacauuuaaggugaucgaaggguggucuaacccuaaauccaagcugcagauuaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucucuggaccuccaacucuaucguggucuucuguggcacaagcgggaccuacggaacaggcuccuggcccgauggggccgaccugaaucuuaugccuauuuga

SEQ ID NO: 207045 - RNA, 1410 nt, Artificial Sequence; identical to SEQ ID NO: 205946
  derived and/or modified sequence opt5 from neuraminidase__InfluenzaA__AHC58710

SEQ ID NO: 207046 - RNA, 1410 nt, Artificial Sequence; identical to SEQ ID NO: 205946
  derived and/or modified sequence opt5 from neuraminidase__InfluenzaA__AHC58722

SEQ ID NO: 207047 - RNA, 1410 nt, Artificial Sequence
  derived and/or modified sequence opt5 from neuraminidase__InfluenzaA__AHC58734
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcaucagaugugugugccgggauaauuggaaagggagcaaccgcccuauugucgacaucaauauuaaggaucacucuaucguguccagcuacguuuguucuggacuugugggcgacacccccagaaagaacgacagcuccucuagcucccauugccuggauccgaauaacgaggaaggcgggcacggagucaagggcugggccuucgacgaugggaaugacguguggaugggacggacgaucaacgagacaagccgccucggcuaugagaccuuuaaaguuauugaaggguggucuaauccuaaguccaaacugcagaucaacagacaggugauugucgaucggggaaaucgcagcggcuacucuggcaucuucuccguggaggggaaaagcuguauuaacagaugcuuuuaugucgaacugauccggggaagaaaggaggaaaccgaggugcucuggacauccaauucuauuguuguguucuguggcaccagcgggacauacggaacgggcuccuggcccgacggggcugaucugaaccuuaugccuaucuga

SEQ ID NO: 207048 - RNA, 1410 nt, Artificial Sequence; identical to SEQ ID NO: 206995
  derived and/or modified sequence opt5 from neuraminidase__InfluenzaA__AHC58746

SEQ ID NO: 207049 - RNA, 1410 nt, Artificial Sequence; identical to SEQ ID NO: 206999
  derived and/or modified sequence opt5 from neuraminidase__InfluenzaA__AHC58758

SEQ ID NO: 207050 - RNA, 1410 nt, Artificial Sequence; identical to SEQ ID NO: 206995
  derived and/or modified sequence opt5 from neuraminidase__InfluenzaA__AHC58770

SEQ ID NO: 207051 - RNA, 1410 nt, Artificial Sequence; identical to SEQ ID NO: 202542
  derived and/or modified sequence opt5 from neuraminidase__InfluenzaA__AHC58782

SEQ ID NO: 207052 - RNA, 1410 nt, Artificial Sequence; identical to SEQ ID NO: 206995
  derived and/or modified sequence opt5 from neuraminidase__InfluenzaA__AHC58806

SEQ ID NO: 207053 - RNA, 1410 nt, Artificial Sequence
  derived and/or modified sequence opt5 from neuraminidase__InfluenzaA__AHC58818
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauccgccuguccgcgggaggcgacauuugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcaucgccugguccucuagcuccugucaugacggaaaagccuggcugcacgugugcauuacaggcgaugacaagaacgcuaccgccagcuucaucuacaauggccggcuuguugauucuguggucuccuggagcaaagagauucugcgcacccaggaaucugagugugugugcaucaacgggacauguacgguggucaugaccgacggauccgcuagcggcaaggccgauacaaaaauccucuuuauugaggaagggaagaucguucauaccuccacacugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugauugaaggguggucuaacccuaaauccaagcugcagaucaaucggcaggucauuguggaccgcggaaacagaagcggcuacucuggcaucuucuccgucgaggggaaaagcuguauuaaucggugcuuuuauguggaacugaucagaggacgcaaggaggaaaccgagguucucuggacauccaacucuauuguggucuucuguggcaccagcgggacauacggaacgggcuccuggcccgauggggcugaccugaaucuuaugccuaucuga

SEQ ID NO: 207054 - RNA, 1410 nt, Artificial Sequence; identical to SEQ ID NO: 207044
  derived and/or modified sequence opt5 from neuraminidase__InfluenzaA__AHC58830

SEQ ID NO: 207055 - RNA, 1410 nt, Artificial Sequence; identical to SEQ ID NO: 206995
  derived and/or modified sequence opt5 from neuraminidase__InfluenzaA__AHC58842

SEQ ID NO: 207056 - RNA, 1410 nt, Artificial Sequence
  derived and/or modified sequence opt5 from neuraminidase__InfluenzaA__AHC58866
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaacagaguuaugcuuugcgaacccacaauuaucgagcggaauauuaccgaaaucguguaccugacaaacaccacgauugagaaggaaaucuguccuaaacucgcugaguaucgcaauugguccaagccccagugcgacauuaccggguucgccccuuuuucuaaagauaacagcaucagacuguccgcgggaggcgacaucugggugacacgggagcccuacgucucuugugauccuaauaagugcuaucaguucgcucuugggcaaggaaccacacugaacaaugugcauagcaacaauaccguucgcgacagaacgccguaccggacacuccugaugaacgaacugggcgugcccuuucaccucgggaccaagcaggucuguauugccugguccagcagcuccugccaugauggaaaagccuggcugcacguguguaucacaggcgacgauaagaaugcuaccgccagcuucauuuauaacggcaaacuuguugacucuguggucuccuggagcaaggagauccugcgcacccaggaaucugagugcguguguauuaacgggacaugcacgguggucaugaccgauggauccgcuagcggcaaagccgacacaaagauccucuuuaucgaggaagggaagauuguucauaccuccacacugucuggaagcgcgcagcacguggaggaaugcuccuguuacccuagauaucccggcgugcggugcgucugucgcgauaauuggaaagggagcaacagaccuaucguggacauuaauaucaaggaucacucuauuguuuccagcuacgugugcucuggacuugucggcgacacgccccggaaaaacgacagcuccucuagcucccauugucuggauccgaauaacgaggaaggcgggcacggagugaagggcugggccuucgacgaugggaaugacguuuggaugggacgcaccaucaacgagacaagcagacucggcuacgagaccuuuaaagugaucgaaggguggucuaauccuaaguccaaacugcaaauuaaccggcaggucaucguggaucgcggaaauagaagcggcuauucuggcauuuucuccgucgaggggaagucuugcaucaaccgguguuuuuacguggaacugauuagaggacgcaaggaggaaaccggcguucucuggacauccaauucuaucguggucuucugcgggaccagcggaacauauggcacgggguccuggcccgacggcgcugaucugaaccuuaugccuauuuga

SEQ ID NO: 207057 - RNA, 1410 nt, Artificial Sequence; identical to SEQ ID NO: 207044
  derived and/or modified sequence opt5 from neuraminidase__InfluenzaA__AHC58878

SEQ ID NO: 207058 - RNA, 1410 nt, Artificial Sequence; identical to SEQ ID NO: 206995
  derived and/or modified sequence opt5 from neuraminidase__InfluenzaA__AHC58890

SEQ ID NO: 207059 - RNA, 1410 nt, Artificial Sequence; identical to SEQ ID NO: 206999
  derived and/or modified sequence opt5 from neuraminidase__InfluenzaA__AHC58902

SEQ ID NO: 207060 - RNA, 1410 nt, Artificial Sequence; identical to SEQ ID NO: 206995
  derived and/or modified sequence opt5 from neuraminidase__InfluenzaA__AHC58996

SEQ ID NO: 207061 - RNA, 1410 nt, Artificial Sequence; identical to SEQ ID NO: 206995
  derived and/or modified sequence opt5 from neuraminidase__InfluenzaA__AHC59008

SEQ ID NO: 207062 - RNA, 1410 nt, Artificial Sequence; identical to SEQ ID NO: 206999
  derived and/or modified sequence opt5 from neuraminidase__InfluenzaA__AHC59020

SEQ ID NO: 207063 - RNA, 1410 nt, Artificial Sequence
  derived and/or modified sequence opt5 from neuraminidase__InfluenzaA__AHC59032
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccagcgugagaugugucugccgggauaauuggaaaggcucuaaccgcccuaucguggacauuaauaucaaggaucacuccauuguuagcucuuacguguguagcgggcuugucggagacacccccagaaagaacgacuccucuagcuccagccauugccuggauccgaauaacgaggaaggcggccacggggugaaaggaugggccuucgacgauggcaaugacguuuggauggggcggacgaucaacgagacaucucgccucggauaugagaccuuuaaagugaucgaaggcugguccaauccuaagagcaaacugcagauuaacagacaggucaucguggaucgggggaaucgcucuggauacuccggcauuuucagcgucgagggcaaguccuguaucaacagaugcuuuuauguggaacugauucgggggagaaaggaggaaaccgagguucucuggacaucuaauagcaucguggucuucuguggaaccuccggcacauacgggacgggaucuuggcccgacggcgcugaucugaaccuuaugccuauuuga

SEQ ID NO: 207064 - RNA, 1410 nt, Artificial Sequence; identical to SEQ ID NO: 207031
  derived and/or modified sequence opt5 from neuraminidase__InfluenzaA__AHC59044

SEQ ID NO: 207065 - RNA, 1410 nt, Artificial Sequence; identical to SEQ ID NO: 202542
  derived and/or modified sequence opt5 from neuraminidase__InfluenzaA__AHC59056

SEQ ID NO: 207066 - RNA, 1410 nt, Artificial Sequence; identical to SEQ ID NO: 206995
  derived and/or modified sequence opt5 from neuraminidase__InfluenzaA__AHC59068

SEQ ID NO: 207067 - RNA, 1410 nt, Artificial Sequence; identical to SEQ ID NO: 206995
  derived and/or modified sequence opt5 from neuraminidase__InfluenzaA__AHC59080

SEQ ID NO: 207068 - RNA, 1410 nt, Artificial Sequence
  derived and/or modified sequence opt5 from neuraminidase__InfluenzaA__AHC59092
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcaucgccugguccucuagcuccugucaugacggaaaggccuggcuccacguuugcauuacaggcgaugacaagaacgcuaccgccagcuucaucuacaauggccggcugguggauucugucguguccuggagcaaagagauucuucgcacccaggaaucugagugugugugcaucaacgggacauguacggucguuaugaccgacggauccgcuagcggcaaggccgauacaaaaauucuguuuaucgaggaagggaagaucgugcauaccuccacacucucuggaagcgcgcaacacguggaggaaugcuccugcuaucccagauacccuggcguccggugugugugccgcgacaacuggaaggggagcaauagacccauuguugauaucaacauuaaagaccacucuaucguguccagcuacgucuguucuggacuggugggcgacaccccgcggaagaaugauagcuccucuagcggccauugccuugacccuaacaaugaggaagggggacacggcguuaaagggugggccuucgaugacggaaacgauguguggaugggccgcacgauuaaugagacauccagacugggguaugagaccuuuaaggucaucgaaggauggagcaaccccaaaucuaagcuccagaucaaucgccaggugauugucgaccggggcgauagauccggcuacagcgggaucuucucuguggagggaaaauccuguauuaaccggugcuuuuauguugaacugaucagaggccgcaaggaggaaaccgaggugcuguggacaagcaauuccauugucguguucugugggaccucuggaacauacggcacggggagcuggccugacggcgcugaucucaaccugaugcccaucuga

SEQ ID NO: 207069 - RNA, 1410 nt, Artificial Sequence
  derived and/or modified sequence opt5 from neuraminidase__InfluenzaA__AHC59104
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucaagagaaacauuaccgagaucguguaccugacaaauaccacgauugaaaaagagaucugcccuaagcucgcugaauaucggaacugguccaaaccccagugugacauuaccggguucgccccuuuuucuaaggauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgagcugggcgugcccuuucaccucgggaccaaacaggucugcauugccugguccagcagcuccugucaugacggaaaggccuggcugcacgugugcaucacaggcgaugacaaaaaugcuaccgccagcuucauuuauaacggccggcuuguugauucuguggucuccuggagcaaggaaauccugcgcacccaggagucugaaugugugugcauuaaugggacauguacgguggucaugaccgacggauccgcuagcggcaaagccgauacaaagauccucuuuaucgaggaggggaagauuguucauaccuccacacugucuggaagcgcgcaacacguggaagagugcuccugcuacccuagauaccccggcgugcggugugucugccgcgacaacuggaaagggagcaacagaccuaucguggauauuaauaucaaggaccacucuauuguuuccagcuauguguguucuggacuugucggcgacacgccccggaaaaacgauagcuccucuagcucccauugccuggacccgaauaacgaagagggcgggcacggagugaagggcugggccuucgaugacgggaaugauguuuggaugggacgcaccaucaacgaaacaagcagacucggcuacgagaccuuuaaagugaucgagggguggucuaauccuaaguccaaacugcagauuaaccggcaggucaucguggaccgcggaaauagaagcggcuauucuggcauuuucuccgucgaagggaagucuuguaucaaccggugcuuuuacguggagcugauuagaggacgcaaggaagagaccgaaguucucuggacauccaauucuaucguggucuucuguggcaccagcgggacauauggaacgggcuccuggcccgauggggcugaccugaaccuuaugccuauuuga

SEQ ID NO: 207070 - RNA, 1410 nt, Artificial Sequence
  derived and/or modified sequence opt5 from neuraminidase__InfluenzaA__AHC59116
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcgggcacggagugaagggcugggccuucgacgaugggaaugacguuuggaugggacggacgaucaacgagacaagccgccucggcuaugagaccuuuaaagugaucgaaggguggucuaauccuaaguccaaacugcagauuaacagacaggucaucguggaucggggaaaucgcagcggcuacucuggcauuuucuccgucgaggggaaaagcuguaucaacagaugcuuuuauguggaacugauucggggaagagaggaagagaccgagguucucuggacauccaauucuaucguggucuucuguggcaccagcgggacauacggaacgggcuccuggcccgacggggcugaucugaaccuuaugccuauuuga

SEQ ID NO: 207071 - RNA, 1410 nt, Artificial Sequence
  derived and/or modified sequence opt5 from neuraminidase__InfluenzaA__AHC59128
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuauggagagaaacaucaccgaaauuguguaccugacaaauaccacgaucgagaaggaaauuugcccuaaacucgcugaguaucggaacugguccaagccccagugugacaucaccggguucgccccuuuuucuaaagauaauagcauucgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcaucgccugguccucuagcuccugucaugacggaaaagccuggcugcacgugugcguuacaggcgaugacaagaaugcuaccgccagcuucauuuauaacggccggcuuguggauucugucguguccuggagcaaagagauccugcgcacccaggaaucugagugugugugcauuaaugggacauguacggucguuaugaccgacggauccgcuagcggcaaggccgauacaaaaauccucuuuauugaggaagggaagaucgugcauaccuccacacugucuggaagcgcgcaacacguggaggaaugcuccugcuacccuagauaccccggcguccggugugugugccgcgacaacuggaaggggagcaacagaccuaucguugauauuaauaucaaagaccacucuauuguguccagcuaugucuguucuggacuugugggcgacacgccccggaagaacgauagcuccucuagcucccauugccuggacccgaauaacgaggaaggcgggcacggaguuaaaggcugggccuucgaugacgggaaugauguguggaugggacgcaccaucaacgagacaagcagacucggcuacgagaccuuuaaggucauugaaggguggucuaauccuaaauccaagcugcagaucaaccgccaggugaucgucgaccggggaaauagaagcggcuauucuggcauuuucuccguggaggggaaaagcuguaucaaccggugcuuuuacguugaacugauuagaggacgcaaggaggaaaccgaggugcucuggacauccaauucuaucgucguguucuguggcaccagcgggacauauggaacgggcuccuggcccgauggggcugaccugaaccuuaugccuauuuga

SEQ ID NO: 207072 - RNA, 1410 nt, Artificial Sequence
  derived and/or modified sequence opt5 from neuraminidase__InfluenzaA__AHC59152
augaaccccaaucagaagaucauuaccaucggcagcgugucccugacaauuucuacgaucugcuucuuuaugcaagucgccauucucaucaccacaguuacccugcacuucaaacaguacgaguuuaacagcccuccgaauaaccaggugaugcuuugugaacccacaaucauugagagaaauaucaccgaaauucuguaucucacaaacaccacgaucgagaaggaaauuugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcaucgccugguccucuagcuccugucaugacggaaaagccuggcuucacgugugcauuacaggcgaugacaagaacgcuaccgccagcuucaucuacaauggcaaacugguugauucuguggucuccuggagcaaggagauucuccggacccaggaaucugagugugugugcaucaacgggacauguacgguggucaugaccgacggauccgcuagcggcaaagccgauacaaagauucuguuuaucgaggaagggaagaucguucauaccuccacacuuucuggaagcgcgcaacacguggaggaaugcuccugcuauccucgcuaccccggcgugagaugugucugccgggacaacuggaaagggagcaaucgcccuauuguggauaucaacauuaaggaccacucuaucguuuccagcuacguguguucuggacuggucggcgacacccccagaaagaaugauagcuccucuagcucccauugccucgacccgaacaaugaggaaggcgggcacggagugaagggcugggccuucgaugacgggaacgauguuuggaugggacggacgauuaaugagacaagccgccugggcuaugagaccuuuaaagugaucgaaggguggucuaacccuaaguccaaacugcagaucaauagacaggucauuguggaccggggaaaccgcagcggcuacucuggcaucuucuccgucgaggggaaaagcuguauuaauagaugcuuuuauguggaacucauccggggaagaaaggaggaaaccgagguucuguggacauccaacucuauuguggucuucuguggcaccagcgggacauacggaacgggcuccuggcccgauggggcugaccuuaaucugaugccuaucuga

SEQ ID NO: 207073 - RNA, 1410 nt, Artificial Sequence
  derived and/or modified sequence opt5 from neuraminidase__InfluenzaA__AHC59188
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguugugcuuugugaaccuacaauuaucgagagaaauauuaccgaaaucguguaucugacaaacaccacgauugagaaggaaaucugccccaaacucgcugaguaccggaauuggagcaagccucagugugacauuaccggguucgcccccuuuuccaaagauaacucuauccgccugagcgcgggaggcgacaucugggucacaagagagccuuauguguccugcgauccggacaaguguuaccaauucgcucuugggcagggaaccacacugaauaacguucauucuaauaacaccgugcgggaucgcacgcccuauagaacacuccugaugaaugaacugggcgucccuuuucaccucgggaccaaacaggugugcauugccuggagcuccagcucuugucaugacggaaaggccuggcugcacguuugcaucacaggcgaugacaagaacgcuaccgccuccuucauuuacaauggccggcuuguggauagcgucgugucuugguccaaagagauccugcgcacccaggaaagcgagugugugugcauuaacgggacauguacggucguuaugaccgacggaucugcuuccggcaaggccgauacaaaaauccucuuuaucgaggaagggaagauugugcauaccagcacacuguccggaucugcgcaacacguggaggaaugcagcugcuaucccagauacccuggcguccggugugugugccgcgacaacuggaagggguccaauagacccaucguugauauuaacaucaaagaccacagcauugugucuuccuacgucuguagcggacuugugggcgacaccccgcggaagaaugauucuagcuccucuagccauugccuggacccuaacaaugaggaaggcgggcacggaguuaaaggcugggccuucgaugacgggaacgauguguggaugggacgcacgaucaaugagacauccagacucggcuaugagaccuuuaaggucaucgaaggguggagcaaccccaaaucuaagcugcagauuaaucgccaggugaucgucgaccggggagauagauccggcuacagcggcauuuucucuguggaggggaaauccuguaucaaccggugcuuuuauguugaacugauuagaggacgcaaggaggaaaccgaggugcucuggacaagcaauuccaucgucguguucuguggcaccucugggacauacggaacgggcagcuggccugacggggcugaucugaaccuuaugcccauuuga

SEQ ID NO: 207074 - RNA, 1410 nt, Artificial Sequence; identical to SEQ ID NO: 202542
  derived and/or modified sequence opt5 from neuraminidase__InfluenzaA__AHC59200

SEQ ID NO: 207075 - RNA, 1410 nt, Artificial Sequence
  derived and/or modified sequence opt5 from neuraminidase__InfluenzaA__AHC59212
augaaccccaaucagaagaucauuaccaucggcagcgugucccugacaauuucuacgaucugcuucuuuaugcaaauugccacccucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuguggucuccuggagcaaagagauucugcgcacacaggaaucugagugugugugcaucaacgggacguguaccguggucaugacagacggauccgcuagcggcaaggccgauaccaaaauucucuuuaucgaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcacaauuaaugagaccagcagacucggcuaugagaccuuuaaggugaucgaaggguggucuaacccuaaauccaagcugcagaucaaucggcaggucauuguggaccgcggagauagaagcggcuacucuggcaucuucuccgucgaggggaaaagcuguauuaaccggugcuuuuauguggaacugaucagaggacgcaaggaggaaacagagguucucuggaccuccaauucuauuguggucuucuguggcacaagcgggacguacggaaccggcuccuggcccgacggggcugaucugaaccuuaugccuaucuga

SEQ ID NO: 207076 - RNA, 1410 nt, Artificial Sequence; identical to SEQ ID NO: 206999
  derived and/or modified sequence opt5 from neuraminidase__InfluenzaA__AHC59224

SEQ ID NO: 207077 - RNA, 1410 nt, Artificial Sequence
  derived and/or modified sequence opt5 from neuraminidase__InfluenzaA__AHC59236
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucacgaucggacgccguaccgcacacuccugaugaacgaacugggcgugcccuuucaucucgggaccaagcaggucugcauugccugguccucuagcuccugucacgacggaaaagccuggcugcaugugugcaucacaggcgaugacaagaaugcuaccgccagcuucauuuauaacggcagacuuguugauucuguggucuccuggagcaaagagauccugcggacccaggaaucugagugugugugcauuaaugggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuacccucgcuaccccggcgugagaugugucugccgggacaacuggaaggggagcaaccgcccuaucguggauauuaauaucaaagaccauucuauuguuuccagcuauguguguucuggacuugucggcgacacccccagaaagaacgauagcuccucuagcucccacugccuggacccgaauaacgaggaaggcgggcauggagugaaaggcugggccuucgaugacgggaaugauguuuggaugggacggacgaucaacgagacaagccgccucggcuacgagaccuuuaaggugaucgaaggguggucuaauccuaaauccaagcugcagauuaacagacaggucaucguggaccggggaaaucgcagcggcuauucuggcauuuucuccgucgaggggaaaagcuguaucaacagaugcuuuuacguggaacugauucggggaagaaaggaggaaaccgagguucucuggacauccaauucuaucguggucuucuguggcaccagcgggacauauggaacgggcuccuggcccgauggggcugaccugaaccuuaugccuauuuga

SEQ ID NO: 207078 - RNA, 1410 nt, Artificial Sequence; identical to SEQ ID NO: 206999
  derived and/or modified sequence opt5 from neuraminidase__InfluenzaA__AHC59260

SEQ ID NO: 207079 - RNA, 1410 nt, Artificial Sequence; identical to SEQ ID NO: 206995
  derived and/or modified sequence opt5 from neuraminidase__InfluenzaA__AHC59272

SEQ ID NO: 207080 - RNA, 1410 nt, Artificial Sequence; identical to SEQ ID NO: 206999
  derived and/or modified sequence opt5 from neuraminidase__InfluenzaA__AHC59284

SEQ ID NO: 207081 - RNA, 1410 nt, Artificial Sequence
  derived and/or modified sequence opt5 from neuraminidase__InfluenzaA__AHC59296
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaagaucaaagaucacucuauuguuuccagcuacguguguucuggacuugucggcgacacccccagaaagaaugacagcuccucuagcucccauugccuggauccgaacaaugaggaaggcgggcacggagugaaaggcugggccuucgacgaugggaacgacguuuggaugggacggacgaucaaugagacaagccgccucggcuaugagaccuuuaaggugaucgaaggguggucuaacccuaaauccaagcugcagauuaauagacaggucaucguggaucggggaaaccgcagcggcuacucuggcauuuucuccgucgaggggaagucuuguaucaauagaugcuuuuauguggaacugauucggggaagaaaagaggaaaccgagguucucuggacauccaacucuaucguggucuucuguggcaccagcgggacauacggaacgggcuccuggcccgacggggcugaucugaaucuuaugccuauuuga

SEQ ID NO: 207082 - RNA, 1410 nt, Artificial Sequence
  derived and/or modified sequence opt5 from neuraminidase__InfluenzaA__AHC59308
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucagugugacauuaccggguucgcccccuuuuccaaagauaacucuauccgccugagcgcgggaggcgacaucugggugacaagagagccuuaugucuccugcgauccgaauaaguguuaccaauucgcucuugggcagggaaccacacugaacaaugugcauucuaacaauaccguucgggaccgcacgcccuauagaacacuccugaugaacgaacugggcgugccuuuucaccucgggaccaagcaggucugcauugccuggagcuccagcucuugucaugauggaaaagccuggcugcacgugugcaucacaggcgacgauaagaaugcuaccgccuccuucauuuacaacggcaaacuuguugacagcguggucucuugguccaaggagauccugcggacccaggaaagcgagugugugugcauuaacgggacauguacgguggucaugaccgauggaucugcuuccggcaaagccgacacaaagauccucuuuaucgaggaagggaagauuguucauaccagcacacuguccggaucugcgcaacacguggaggaaugcagcugcuauccccgcuacccuggcgugagaugugucugccgggauaauuggaaaggguccaaccgccccaucguggacauuaauaucaaggaucacagcauuguuucuuccuacguguguagcggacuugucggcgacaccccgcggaaaaacgacucuagcuccucuagccauugccuggauccuaauaacgaggaaggcgggcacggagugaagggcugggccuucgacgaugggaaugacguuuggaugggaagaacgaucaacgagacaucccgccucggcuaugagaccuuuaaagugaucgaaggguggagcaaucccaagucuaaacugcagauuaacagacaggucaugguggaucggggaaaucgcuccggcuacagcggcaucuucucugucgaggggaaguccuguauuaacagaugcuuuuauguggaacugauccggggaagaaaggaggaaaccgagguucucuggacaagcaauuccauuguggucuucuguggcaccucugggacauacggaacgggcagcuggccugacggggcugaucugaaccuuaugcccaucuga

SEQ ID NO: 207083 - RNA, 1410 nt, Artificial Sequence; identical to SEQ ID NO: 206907
  derived and/or modified sequence opt5 from neuraminidase__InfluenzaA__AHC59320

SEQ ID NO: 207084 - RNA, 1410 nt, Artificial Sequence; identical to SEQ ID NO: 205170
  derived and/or modified sequence opt5 from neuraminidase__InfluenzaA__AHC59332

SEQ ID NO: 207085 - RNA, 1410 nt, Artificial Sequence; identical to SEQ ID NO: 207043
  derived and/or modified sequence opt5 from neuraminidase__InfluenzaA__AHC59344

SEQ ID NO: 207086 - RNA, 1410 nt, Artificial Sequence
  derived and/or modified sequence opt5 from neuraminidase__InfluenzaA__AHC59368
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcgggcacggagugaagggcugggccuucgacgaugggaaugacguuuggaugggacggacgaucgaugagacaagccgccucggcuaugagaccuuuaaagugaucgaaggguggucuaacccuaaguccaaacugcagauuaauagacaggucaucguggaccggggaaaccgcagcggcuacucuggcauuuucuccgucgaggggaaaagcuguaucaauagaugcuuuuauguggaacugauucggggaagaaaggaggaaaccgagguucucuggacauccaacucuaucguggucuucuguggcaccagcgggacauacggaacgggcuccuggcccgauggggcugaccugaaucuuaugccuauuuga

SEQ ID NO: 207087 - RNA, 1410 nt, Artificial Sequence; identical to SEQ ID NO: 206995
  derived and/or modified sequence opt5 from neuraminidase__InfluenzaA__AHC59380

SEQ ID NO: 207088 - RNA, 1410 nt, Artificial Sequence; identical to SEQ ID NO: 205946
  derived and/or modified sequence opt5 from neuraminidase__InfluenzaA__AHC59392

SEQ ID NO: 207089 - RNA, 1410 nt, Artificial Sequence; identical to SEQ ID NO: 207031
  derived and/or modified sequence opt5 from neuraminidase__InfluenzaA__AHC59404

SEQ ID NO: 207090 - RNA, 1410 nt, Artificial Sequence; identical to SEQ ID NO: 206999
  derived and/or modified sequence opt5 from neuraminidase__InfluenzaA__AHC59416

SEQ ID NO: 207091 - RNA, 1410 nt, Artificial Sequence
  derived and/or modified sequence opt5 from neuraminidase__InfluenzaA__AHC59428
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugaccgguguuaucaauucgcucuugggcagggaaccacacugaacaaugugcauagcaacaauaccguucgcgauagaacgccguaccggacacuccugaugaacgaacugggcgugcccuuucaccucgggaccaagcaggucugcauugccugguccagcagcuccugucaugacggaaaggccuggcugcacgugugcaucacaggcgaugacaaaaaugcuaccgccagcuucauuuauaacggccgccuuguugauucuguggucuccuggagcaaggagauccugagaacccaggaaucugagugugugugcauuaaugggacauguacgguggucaugaccgacggauccgcuagcggcaaagccgauacaaagauccucuuuaucgaggaagggaaaauuguucauaccuccacacugucuggaagcgcgcaacacguggaggaaugcuccugcuacccucgguaccccggcgugcgcugugucugcagagacaacuggaaggggagcaaccggccuaucguggauauuaauaucaaggaccacucuauuguuuccagcuauguguguucuggacuugucggcgacacgccccgcaaaaacgauagcuccucuagcucccauugccuggacccgaauaacgaggaaggcgggcacggagugaagggcugggccuucgaugacgggaaugauguuuggaugggaagaaccaucaacgagacaagccggcucggcuacgagaccuuuaaagugaucgaaggguggucuaauccuaaguccaaacugcagauuaaccgccaggucaucguggacagaggaaaucggagcggcuauucuggcauuuucuccgucgaggggaagucuuguaucaacagaugcuuuuacguggaacugauucgcggacggaaagaggaaaccgagguucucuggacauccaauucuaucguggucuucuguggcaccagcgggacauauggaacgggcuccuggcccgauggggcugaccugaaccuuaugccuauuuga

SEQ ID NO: 207092 - RNA, 1410 nt, Artificial Sequence
  derived and/or modified sequence opt5 from neuraminidase__InfluenzaA__AHC59440
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucaaaccuccacacucucuggaagcgcgcagcauguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccacugccuugacccuaacaaugaggaaggcgggcauggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucuguggacauccaauucuaucguggucuucuguggcaccagcgggacauacggaacgggcuccuggccugacggggcugaucucaaccugaugcccauuuga

SEQ ID NO: 207093 - RNA, 1410 nt, Artificial Sequence; identical to SEQ ID NO: 206999
  derived and/or modified sequence opt5 from neuraminidase__InfluenzaA__AHC59452

SEQ ID NO: 207094 - RNA, 1410 nt, Artificial Sequence; identical to SEQ ID NO: 202542
  derived and/or modified sequence opt5 from neuraminidase__InfluenzaA__AHC59464

SEQ ID NO: 207095 - RNA, 1410 nt, Artificial Sequence; identical to SEQ ID NO: 206907
  derived and/or modified sequence opt5 from neuraminidase__InfluenzaA__AHC59476

SEQ ID NO: 207096 - RNA, 1410 nt, Artificial Sequence; identical to SEQ ID NO: 206999
  derived and/or modified sequence opt5 from neuraminidase__InfluenzaA__AHC59488

SEQ ID NO: 207097 - RNA, 1410 nt, Artificial Sequence; identical to SEQ ID NO: 206999
  derived and/or modified sequence opt5 from neuraminidase__InfluenzaA__AHC59500

SEQ ID NO: 207098 - RNA, 1410 nt, Artificial Sequence; identical to SEQ ID NO: 207044
  derived and/or modified sequence opt5 from neuraminidase__InfluenzaA__AHC59512

SEQ ID NO: 207099 - RNA, 1410 nt, Artificial Sequence; identical to SEQ ID NO: 207044
  derived and/or modified sequence opt5 from neuraminidase__InfluenzaA__AHC59524

SEQ ID NO: 207100 - RNA, 1410 nt, Artificial Sequence; identical to SEQ ID NO: 207031
  derived and/or modified sequence opt5 from neuraminidase__InfluenzaA__AHC59536

SEQ ID NO: 207101 - RNA, 1410 nt, Artificial Sequence; identical to SEQ ID NO: 206999
  derived and/or modified sequence opt5 from neuraminidase__InfluenzaA__AHC59548

SEQ ID NO: 207102 - RNA, 1410 nt, Artificial Sequence; identical to SEQ ID NO: 206999
  derived and/or modified sequence opt5 from neuraminidase__InfluenzaA__AHC59560

SEQ ID NO: 207103 - RNA, 1410 nt, Artificial Sequence; identical to SEQ ID NO: 207077
  derived and/or modified sequence opt5 from neuraminidase__InfluenzaA__AHC59572

SEQ ID NO: 207104 - RNA, 1410 nt, Artificial Sequence; identical to SEQ ID NO: 207072
  derived and/or modified sequence opt5 from neuraminidase__InfluenzaA__AHC59584

SEQ ID NO: 207105 - RNA, 1410 nt, Artificial Sequence; identical to SEQ ID NO: 207044
  derived and/or modified sequence opt5 from neuraminidase__InfluenzaA__AHC59596

SEQ ID NO: 207106 - RNA, 1410 nt, Artificial Sequence; identical to SEQ ID NO: 205946
  derived and/or modified sequence opt5 from neuraminidase__InfluenzaA__AHC59608

SEQ ID NO: 207107 - RNA, 1410 nt, Artificial Sequence; identical to SEQ ID NO: 207031
  derived and/or modified sequence opt5 from neuraminidase__InfluenzaA__AHC59620

SEQ ID NO: 207108 - RNA, 1410 nt, Artificial Sequence; identical to SEQ ID NO: 206999
  derived and/or modified sequence opt5 from neuraminidase__InfluenzaA__AHC59632

SEQ ID NO: 207109 - RNA, 1410 nt, Artificial Sequence; identical to SEQ ID NO: 206999
  derived and/or modified sequence opt5 from neuraminidase__InfluenzaA__AHC59644

SEQ ID NO: 207110 - RNA, 1410 nt, Artificial Sequence
  derived and/or modified sequence opt5 from neuraminidase__InfluenzaA__AHC59656
augaaccccaaucagaagaucauuaccaucggcagcgugucccugacaauuucuacgaucugcuucuuuaugcaaauugccauccucaucaccacagucaccaugcacuucaaacaguacgaguuuaacagcccuccgaauaaccagguuaugcugugugaacccacaauuaucgagagaaauauuaccgaaaucguguaucuuacaaacaccacgauugagaaggaaaucugcccuaaacuggcugaguaccggaauugguccaagccccagugugacauuaccggguucgccccuuuuucuaaagauaacagcauccgccucuccgcgggaggcgacaucugggugacaagagagcccuaugucucuugcgauccugugaaguguuaccaauucgcucuggggcagggaaccacacuuaauaacguucauagcaauaacaccgugcgggaccgcacgccguauagaacacugcucaugaaugaacugggcguccccuuucaccuggggaccaaacaggugugcauugccugguccagcagcuccugucaugauggaaaagccuggcuccacguuugcaucacaggcgacgauaagaacgcuaccgccagcuucauuuacaauggcaaacugguggacucugucguguccuggagcaaggagauccuucggacccaggaaucugagugugugugcauuaacgggacauguacggucguuaugaccgauggauccgcuagcggcaaagccgacacaaagauccuguuuaucgaggaagggaagauugugcauaccuccacacucucuggaagcgcgcaacacguggaggaaugcuccugcuauccucgcuaccccggcgucagaugugugugccgggauaacuggaaagggagcaaucgcccuaucguugacauuaacaucaaggaucacucuauuguguccagcuacgucuguucuggacuggugggcgacacccccagaaagaaugacagcuccucuagcucccauugccuugauccgaacaaugaggaaggcgggcacggaguuaagggcugggccuucgacgaugggaacgacguguggaugggacggacgaucaaugagacaagccgccugggcuaugagaccuuuaaagucaucgaaggguggucuaacccuaaguccaaacuccagauuaauagacaggugaucgucgaucggggaaaccgcagcggcuacucuggcauuuucuccguggaggggaagucuuguaucaauagaugcuuuuauguugaacugauucggggaagaaaggaggaaaccgaggugcuguggacauccaacucuaucgucguguucuguggcaccagcgggacauacggaacgggcuccuggcccgacggggcugaucucaaucugaugccuauuuga

SEQ ID NO: 207111 - RNA, 1410 nt, Artificial Sequence; identical to SEQ ID NO: 207044
  derived and/or modified sequence opt5 from neuraminidase__InfluenzaA__AHC59668

SEQ ID NO: 207112 - RNA, 1410 nt, Artificial Sequence; identical to SEQ ID NO: 207072
  derived and/or modified sequence opt5 from neuraminidase__InfluenzaA__AHC59680

SEQ ID NO: 207113 - RNA, 1410 nt, Artificial Sequence; identical to SEQ ID NO: 206999
  derived and/or modified sequence opt5 from neuraminidase__InfluenzaA__AHC59704

SEQ ID NO: 207114 - RNA, 1410 nt, Artificial Sequence; identical to SEQ ID NO: 202542
  derived and/or modified sequence opt5 from neuraminidase__InfluenzaA__AHC59716

SEQ ID NO: 207115 - RNA, 1410 nt, Artificial Sequence; identical to SEQ ID NO: 202542
  derived and/or modified sequence opt5 from neuraminidase__InfluenzaA__AHC59728

SEQ ID NO: 207116 - RNA, 1410 nt, Artificial Sequence; identical to SEQ ID NO: 207044
  derived and/or modified sequence opt5 from neuraminidase__InfluenzaA__AHC59752

SEQ ID NO: 207117 - RNA, 1410 nt, Artificial Sequence; identical to SEQ ID NO: 207031
  derived and/or modified sequence opt5 from neuraminidase__InfluenzaA__AHC59764

SEQ ID NO: 207118 - RNA, 1410 nt, Artificial Sequence
  derived and/or modified sequence opt5 from neuraminidase__InfluenzaA__AHC59776
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccucuagcuccugucaugacggaaaagccuggcugcacgugugcaucacaggcgaugacaagaaugcuaccgccagcuucauuuauaacggcaaacuuguugauucuguggucuccuggagcaaggagauccugcggacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuacccucgcuaccccggcgugagaugugucugccgggacaacuggaaagggagcaaccgcccuaucguggauauuaauaucaaggaccacucuauuguuuccagcuauguguguucuggacuugucggcgacacccccagaaagaacgauagcuccucuagcucccauugccuggacccgaauaacgaggaaggcgggcacggagugaagggcugggccuucgaugacgggaaugauguuuggaugggacggacgaucaacgagacaagccgccucggcuacgagaccuuuaaagugaucgaaggguggucuaauccuaaguccaaacugcagauuaacagacaggucaucguggaccggggaaaucgcagcggcuauucuggcauuuucuccgucgaggggaaaagcuguaucaacagaugcuuuuacguggaacugauucggggaagaaaggaggaaaccgagguucucuggacauccaauucuaucguggucuucuguggcaccagcgggacauauggaacgggcuccuggcccgauggggcugaccugaaccuuaugccuauuuga

SEQ ID NO: 207119 - RNA, 1410 nt, Artificial Sequence; identical to SEQ ID NO: 206995
  derived and/or modified sequence opt5 from neuraminidase__InfluenzaA__AHC59788

SEQ ID NO: 207120 - RNA, 1410 nt, Artificial Sequence; identical to SEQ ID NO: 207072
  derived and/or modified sequence opt5 from neuraminidase__InfluenzaA__AHC59800

SEQ ID NO: 207121 - RNA, 1410 nt, Artificial Sequence
  derived and/or modified sequence opt5 from neuraminidase__InfluenzaA__AHC59812
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcauugccugguccucuagcuccugucaugacggaaaggccuggcuccacguuugcaucacaggcgaugacaagaacgcuaccgccagcuucauuuacaauggccggcugguggauucugucguguccuggagcaaagagauccuucgcacccaggaaucugagugugugugcauuaacgggacauguacggucguuaugaccgacggauccgcuagcggcaaggccgauacaaaaauccuguuuaucgaggaagggaagauuguguauaccuccacacucucuggaagcgcgcaacauguggaggaaugcuccugcuaccccagauacccuggcguccggugugugugccgcgacaacuggaaggggagcaauagacccaucguugauauuaacaucaaagaccacucuauuguguccagcuaugucuguucuggacuggugggcgacaccccgcggaagaaugauagcuccucuagcucccacugccuugacccuaacaaugaggaaggcgggcauggaguuaaaggcugggccuucgaugacgggaacgauguguggaugggacgcacgaucaaugagacaagcagacugggcuacgagaccuuuaaggucaucgaaggguggucuaaccccaaauccaagcuccagauuaaucgccaggugaucgucgaccggggagauagaagcggcuauucuggcauuuucuccguggaggggaaaagcuguaucaaccggugcuuuuacguugaacugauuagaggacgcaaggaggaaaccgaggugcuguggacauccaauucuaucgucguguucuguggcaccagcgggacauauggaacgggcuccuggccugacggggcugaucucaaccugaugcccauuuga

SEQ ID NO: 207122 - RNA, 1410 nt, Artificial Sequence
  derived and/or modified sequence opt5 from neuraminidase__InfluenzaA__AHC59824
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaagugguccaaaccccagugugacauuaccggguucgccccuuuuucuaaggauaacagcauccgccuguccgcgggaggcgacaucugggugacaagagagcccuacgucucuugcgauccugacaaguguuaucaauucgcucuugggcagggaaccacacugaauaacgugcauagcaauaacaccguucgggaucgcacgccguacagaacacuccugaugaaugaacugggcgugcccuuucaccucgggaccaaacaggucugcauugccugguccagcagcuccugucaugacggaaaggccuggcugcacgugugcaucacaggcgaugacaaaaacgcuaccgccagcuucauuuauaauggccggcuuguugauucuguggucuccuggagcaaggagauccugcgcacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuacccuagauaccccggcgugcggugugucugccgcgacaauuggaaagggagcaacagaccuaucguggauauuaacaucaaggaccacucuauuguuuccagcuauguguguucuggacuugucggcgacacgccccggaaaaaugauagcuccucuagcucccauugccuggacccgaacaaugaggaaggcgggcacggagugaagggcugggccuucgaugacgggaacgauguuuggaugggacgcaccaucaaugagacaagcagacucggcuacgagaccuuuaaagugaucgaaggguggucuaacccuaaguccaaacugcagauuaaucggcaggucaucguggaccgcggaaacagaagcggcuauucuggcauuuucuccgucgaggggaagucuuguaucaaucggugcuuuuacguggaacugauuagaggacgcaaggaggaaaccgagguucucuggacauccaacucuaucguggucuucuguggcaccagcgggacauauggaacgggcuccuggcccgauggggcugaccugaaucuuaugccuauuuga

SEQ ID NO: 207123 - RNA, 1410 nt, Artificial Sequence; identical to SEQ ID NO: 206999
  derived and/or modified sequence opt5 from neuraminidase__InfluenzaA__AHC59836

SEQ ID NO: 207124 - RNA, 1410 nt, Artificial Sequence; identical to SEQ ID NO: 205946
  derived and/or modified sequence opt5 from neuraminidase__InfluenzaA__AHC59848

SEQ ID NO: 207125 - RNA, 1410 nt, Artificial Sequence; identical to SEQ ID NO: 206995
  derived and/or modified sequence opt5 from neuraminidase__InfluenzaA__AHC59860

SEQ ID NO: 207126 - RNA, 1410 nt, Artificial Sequence; identical to SEQ ID NO: 207042
  derived and/or modified sequence opt5 from neuraminidase__InfluenzaA__AHC59872

SEQ ID NO: 207127 - RNA, 1410 nt, Artificial Sequence; identical to SEQ ID NO: 207031
  derived and/or modified sequence opt5 from neuraminidase__InfluenzaA__AHC59884

SEQ ID NO: 207128 - RNA, 1410 nt, Artificial Sequence
  derived and/or modified sequence opt5 from neuraminidase__InfluenzaA__AHC59895
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucaaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucaaugaaacaagcagacucggcuaugagaccuuuaaagugaucgagggguggucuaacccuaaguccaaacugcagauuaaucggcaggucaucguggaccgcggaaacagaagcggcuacucuggcauuuucuccgucgaagggaagucuuguaucaaucggugcuuuuauguggagcugauuagaggacgcaaggaagagaccgaaguucucuggacauccaacucuaucguggucuucuguggcaccagcgggacauacggaacgggcuccuggcccgauggggcugaccugaaucuuaugccuauuuga

SEQ ID NO: 207129 - RNA, 1410 nt, Artificial Sequence; identical to SEQ ID NO: 206999
  derived and/or modified sequence opt5 from neuraminidase__InfluenzaA__AHC59907

SEQ ID NO: 207130 - RNA, 1410 nt, Artificial Sequence
  derived and/or modified sequence opt5 from neuraminidase__InfluenzaA__AHC59918
augaaccccaaucagaagaucauuaccaucggcagcgugucccugacaauuucuacgaucugcuucuuuauucaaaucgccauccucauuaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauccgccuguccgcgggaggcgacauuugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcaucgccugguccucuagcuccugucaugacggaaaagccuggcugcacgugugcauuacaggcgaugacaagaacgcuaccgccagcuucaucuacaauggccggcuuguugauucuguggucuccuggagcaaagagauucugcgcacccaggaaucugagugugugugcaucaacgggacauguacgguggucaugaccgacggauccgcuagcggcaaggccgauacaaaaauccucuuuauugaggaagggaagaucguucauaccuccacacugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugauugaaggguggucuaacccuaaauccaagcugcagaugaaucggcaggucaucguggaccgcggaaacagaagcggcuacucuggcauuuucuccgucgaggggaaaagcuguaucaaucggugcuuuuauguggaacugauuagaggacgcaaggaggaaaccgagguucucuggacauccaacucuaucguggucuucuguggcaccagcgggacauacggaacgggcuccuggcccgauggggcugaccugaaucuuaugccuauuuga

SEQ ID NO: 207131 - RNA, 1410 nt, Artificial Sequence; identical to SEQ ID NO: 207130
  derived and/or modified sequence opt5 from neuraminidase__InfluenzaA__AHC59930

SEQ ID NO: 207132 - RNA, 1410 nt, Artificial Sequence; identical to SEQ ID NO: 206999
  derived and/or modified sequence opt5 from neuraminidase__InfluenzaA__AHC59942

SEQ ID NO: 207133 - RNA, 1410 nt, Artificial Sequence; identical to SEQ ID NO: 207044
  derived and/or modified sequence opt5 from neuraminidase__InfluenzaA__AHC59954

SEQ ID NO: 207134 - RNA, 1410 nt, Artificial Sequence
  derived and/or modified sequence opt5 from neuraminidase__InfluenzaA__AHC59966
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaaccugcugaguaccggaauuggucuaagccccagugugacauuaccggguucgccccuuuuagcaaagauaacuccauccgccucucugcgggaggcgacaucugggugacaagagagcccuaugucagcugcgauccugacaaguguuaccaauucgcucuggggcagggaaccacacuuaauaacgugcauuccaauaacaccguucgggaucgcacgccguauagaacacugcucaugaaugaacugggcgugcccuuucaccuggggaccaagcaggucugcauugccuggucuagcuccagcugucaugacggaaaagccuggcuccacgugugcaucacaggcgaugacaagaacgcuaccgccucuuucauuuacaauggccggcugguugauuccguggucagcuggucuaaagagauccuucgcacccaggaauccgagugugugugcauuaacgggacauguacgguggucaugaccgacggaagcgcuuccggcaaggccgauacaaaaauccuguuuaucgaggaagggaagauuguucauaccucuacacucagcggauccgcgcaacacguggaggaaugcagcugcuauccuagauaccccggcgugcggugugucugccgcgacaacuggaaggggucuaauagaccuaucguggauauuaacaucaaagaccacuccauuguuagcucuuacguguguagcggacuggucggcgacacgccccggaagaaugauuccucuagcuccagccauugccuugacccgaacaaugaggaaggcgggcacggagugaaaggcugggccuucgaugacgggaacgauguuuggaugggacgcaccaucaaugagacaucuagacugggcuaugagaccuuuaaggugaucgaagggugguccaacccuaaaagcaagcuccagauuaaucggcaggucaucguggaccgcggagauggcucuggcuacuccgggauuuucagcgucgagggaaaauccuguaucaacagaugcuuuuauguggaacugauucggggcagaaaggaggaaaccgagguucuguggacaucuaauagcaucguggucuucugugggaccuccggaacauacggcacggggucuuggcccgacggcgcugaucucaaccugaugccuauuuga

SEQ ID NO: 207135 - RNA, 1410 nt, Artificial Sequence; identical to SEQ ID NO: 205946
  derived and/or modified sequence opt5 from neuraminidase__InfluenzaA__AHC59978

SEQ ID NO: 207136 - RNA, 1410 nt, Artificial Sequence; identical to SEQ ID NO: 203908
  derived and/or modified sequence opt5 from neuraminidase__InfluenzaA__AHC59990

SEQ ID NO: 207137 - RNA, 1410 nt, Artificial Sequence; identical to SEQ ID NO: 207044
  derived and/or modified sequence opt5 from neuraminidase__InfluenzaA__AHC60002

SEQ ID NO: 207138 - RNA, 1410 nt, Artificial Sequence; identical to SEQ ID NO: 206999
  derived and/or modified sequence opt5 from neuraminidase__InfluenzaA__AHC60014

SEQ ID NO: 207139 - RNA, 1410 nt, Artificial Sequence; identical to SEQ ID NO: 202542
  derived and/or modified sequence opt5 from neuraminidase__InfluenzaA__AHC60026

SEQ ID NO: 207140 - RNA, 1410 nt, Artificial Sequence; identical to SEQ ID NO: 206995
  derived and/or modified sequence opt5 from neuraminidase__InfluenzaA__AHC60038

SEQ ID NO: 207141 - RNA, 1410 nt, Artificial Sequence; identical to SEQ ID NO: 206995
  derived and/or modified sequence opt5 from neuraminidase__InfluenzaA__AHC60050

SEQ ID NO: 207142 - RNA, 1410 nt, Artificial Sequence
  derived and/or modified sequence opt5 from neuraminidase__InfluenzaA__AHC60062
augaaccccaaucagaagaucauuaccaucggcagcgugucccugacaauuucuacgaucugcuucuuuaugcaaauugccauccucaucaccacagucaccaugcacuucaaacaguacgaguuuaacagcccuccgaauaaccagguuaugcugugugaacccacaauuaucgagagaaauauuaccgaaaucguguaucuuacaaacaccacgauugagaaggaaaucugcccuaaacuggcugaguaccggaauugguccaagccccagugugacauuaccggguucgccccuuuuucuaaagauaacagcauccgccucuccgcgggaggcgacaucugggugacaagagagcccuaugucucuugcgauccugacaaguguuaccaauucgcucuggggcagggaaccacacuuaauaacgugcauagcaauaacaccguucgggaucgcacgccguauagaacacugcucaugaaugaacugggcgugcccuuucaccuggggaccaagcaggucugcauugccugguccucuagcuccugucaugacggaaaagccuggcuccacgugugcaucacaggcgaugacaagaacgcuaccgccagcuucauuuacaauggcaaacugguugauucuguggucuccuggagcaaggagauccuucggacccaggaaucugagugugugugcauuaacgggacauguacgguggucaugaccgacggauccgcuagcggcaaagccgauacaaagauccuguuuaucgaggaagggaagauuguucauaccuccacacucucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuggucggcgacacccccagaaagaaugauagcuccucuagcucccauugccuugacccgaacaaugaggaaggcgggcacggagugaagggcugggccuucgaugacgggaacgauguuuggaugggacggacgaucaaugagacaagccgccugggcuaugagaccuuuaaagugaucgaaggguggucuaacccuaaguccaaacuccagauuaauagacaggucaucguggaccggggaaaccgcagcggcuacucuggcauuuucuccgucgaggggaaaagcuguaucaauagaugcuuuuauguggaacugauucggggaagaaaggaggaaaccgagguucuguggacauccaacucuaucguggucuucuguggcaccagcgggacauacggaacgggcuccuggcccgauggggcugaccucaaucugaugccuauuuga

SEQ ID NO: 207143 - RNA, 1410 nt, Artificial Sequence; identical to SEQ ID NO: 205946
  derived and/or modified sequence opt5 from neuraminidase__InfluenzaA__AHC60074

SEQ ID NO: 207144 - RNA, 1410 nt, Artificial Sequence; identical to SEQ ID NO: 206999
  derived and/or modified sequence opt5 from neuraminidase__InfluenzaA__AHC60086

SEQ ID NO: 207145 - RNA, 1410 nt, Artificial Sequence
  derived and/or modified sequence opt5 from neuraminidase__InfluenzaA__AHC60098
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccucuagcuccugucaugacggaaaagccuggcugcacgugugcaucacaggcgaugacaagaaugcuaccgccagcuucauuuauaacggccggcuuguugauucuguggucuccuggagcaaagagauccugcgcacccaggaaucugagugugugugcauuaaugggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuacccuagauaccccggcgugcggugugucugccgcgacaacuggaaggggagcaacagaccuaucguggauauuaauaucaaagaccacucuauuguuuccagcuauguguguucuggacuugucggcgacacgccccggaagaacgauagcuccucuagcucccauugccuggacccgaauaacgaggaaggcgggcacggagugaaaggcugggccuucgaugacgggaaugauguuuggaugggacgcaccaucgacgagacaagcagacucggcuacgagaccuuuaaggugaucgaaggguggucuaacccuaaauccaagcugcagauuaaucggcaggucaucguggaucgcggaaacagaagcggcuauucuggcauuuucuccgucgaggggaaaagcuguaucaaucggugcuuuuacguggaacugauuagaggacgcaaggaggaaaccgagguucucuggacauccaacucuaucguggucuucuguggcaccagcgggacauauggaacgggcuccuggcccgacggggcugaucugaaucuuaugccuauuuga

SEQ ID NO: 207146 - RNA, 1410 nt, Artificial Sequence; identical to SEQ ID NO: 206995
  derived and/or modified sequence opt5 from neuraminidase__InfluenzaA__AHC60110

SEQ ID NO: 207147 - RNA, 1410 nt, Artificial Sequence; identical to SEQ ID NO: 207072
  derived and/or modified sequence opt5 from neuraminidase__InfluenzaA__AHC60122

SEQ ID NO: 207148 - RNA, 1410 nt, Artificial Sequence; identical to SEQ ID NO: 206999
  derived and/or modified sequence opt5 from neuraminidase__InfluenzaA__AHC60134

SEQ ID NO: 207149 - RNA, 1410 nt, Artificial Sequence; identical to SEQ ID NO: 207053
  derived and/or modified sequence opt5 from neuraminidase__InfluenzaA__AHC60146

SEQ ID NO: 207150 - RNA, 1410 nt, Artificial Sequence; identical to SEQ ID NO: 207130
  derived and/or modified sequence opt5 from neuraminidase__InfluenzaA__AHC60158

SEQ ID NO: 207151 - RNA, 1410 nt, Artificial Sequence; identical to SEQ ID NO: 206995
  derived and/or modified sequence opt5 from neuraminidase__InfluenzaA__AHC60182

SEQ ID NO: 207152 - RNA, 1410 nt, Artificial Sequence
  derived and/or modified sequence opt5 from neuraminidase__InfluenzaA__AHC60206
augaaccccaaucagaagaucauuaccaucggcagcgugucccugacaauuucuaucauuugcuucuuuaugcaagucgccauccucaucacgaccguuacacugcacuucaaacaguacgaguuuaacagcccuccgaauaaccaggugaugcuuugugaacccaccauuaucgagagaaauauuacagaaaucguguaucugaccaacacaaccauugagaaggaaaucugcccuaaacucgcugaguaccggaauugguccaagccccagugugacauuacgggguucgccccuuuuucuaaagauaacagcauccgccuguccgcgggaggcgacaucugggucaccagagagcccuaugugucuugcgauccugacaaguguuaccaauucgcucuugggcagggaacaacccugaauaacguucauagcaauaacacagugcgggaucgcaccccguauagaacgcuccugaugaaugaacugggcguccccuuucaccucgggacaaaacaggugugcauugccugguccagcagcuccugucaugacggaaaagccuggcugcacguuugcaucaccggcgaugacaagaacgcuacagccagcuucauuuacaauggcaaacuuguggauucugucguguccuggagcaaggagauccugcggacccaggaaucugagugugugugcauuaacgggaccuguacagucguuaugacggacggauccgcuagcggcaaagccgauaccaagauccucuuuaucgaggaagggaagauugugcauacauccacccugucuggaagcgcgcaacacguggaggaaugcuccugcuauccucgcuaccccggcgucagaugugugugccgggacaacuggaaagggagcaaucgcccuaucguugauauuaacaucaaggaccacucuauuguguccagcuacgucuguucuggacuugugggcgacacacccagaaagaaugauagcuccucuagcucccauugccuggacccgaacaaugaggaaggcgggcacggaguuaagggcugggccuucgaugacgggaacgauguguggaugggacggaccaucaaugagacgagccgccucggcuaugagacauuuaaagucaucgaaggguggucuaacccuaaguccaaacugcagauuaauagacaggugaucgucgaccggggaaaccgcagcggcuacucuggcauuuucuccguggaggggaagucuuguaucaauagaugcuuuuauguugaacugauucggggaagaaaggaggaaaccgaggugcucuggaccuccaacucuaucgucguguucuguggcacaagcgggaccuacggaacaggcuccuggcccgauggggcugaccugaaucuuaugccuauuuga

SEQ ID NO: 207153 - RNA, 1410 nt, Artificial Sequence; identical to SEQ ID NO: 205946
  derived and/or modified sequence opt5 from neuraminidase__InfluenzaA__AHC60218

SEQ ID NO: 207154 - RNA, 1410 nt, Artificial Sequence; identical to SEQ ID NO: 202542
  derived and/or modified sequence opt5 from neuraminidase__InfluenzaA__AHC60230

SEQ ID NO: 207155 - RNA, 1410 nt, Artificial Sequence; identical to SEQ ID NO: 206995
  derived and/or modified sequence opt5 from neuraminidase__InfluenzaA__AHC60242

SEQ ID NO: 207156 - RNA, 1410 nt, Artificial Sequence; identical to SEQ ID NO: 206995
  derived and/or modified sequence opt5 from neuraminidase__InfluenzaA__AHC60254

SEQ ID NO: 207157 - RNA, 1410 nt, Artificial Sequence; identical to SEQ ID NO: 206995
  derived and/or modified sequence opt5 from neuraminidase__InfluenzaA__AHC60266

SEQ ID NO: 207158 - RNA, 1410 nt, Artificial Sequence; identical to SEQ ID NO: 207044
  derived and/or modified sequence opt5 from neuraminidase__InfluenzaA__AHC60278

SEQ ID NO: 207159 - RNA, 1410 nt, Artificial Sequence; identical to SEQ ID NO: 206995
  derived and/or modified sequence opt5 from neuraminidase__InfluenzaA__AHC60290

SEQ ID NO: 207160 - RNA, 1410 nt, Artificial Sequence
  derived and/or modified sequence opt5 from neuraminidase__InfluenzaA__AHC60302
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuauccauaccuccacacugucuggaagcgcgcaacacguugaggaaugcuccugcuauccucgcuaccccggcgugagaugugugugccgggauaauuggaaagggagcaaccgcccuauugucgacaucaauauuaaggaucacucuaucguguccagcuacguuuguucuggacuugugggcgacacccccagaaagaacgacagcuccucuagcucccauugccuggauccgaauaacgaggaaggcgggcacggagucaagggcugggccuucgacgaugggaaugacguguggaugggacggacgaucaacgagacaagccgccucggcuaugagaccuuuaaaguuauugaaggguggucuaauccuaaguccaaacugcagaucaacagacaggugauugucgaucggggaaaucgcagcggcuacucuggcaucuucuccguggaggggaaaagcuguauuaacagaugcuuuuaugucgaacugauccggggaagaaaggaggaaaccgaggugcucuggacauccaauucuauuguuguguucuguggcaccagcgggacauacggaacgggcuccuggcccgacggggcugaucugaaccuuaugccuaucuga

SEQ ID NO: 207161 - RNA, 1410 nt, Artificial Sequence; identical to SEQ ID NO: 206995
  derived and/or modified sequence opt5 from neuraminidase__InfluenzaA__AHC60314

SEQ ID NO: 207162 - RNA, 1410 nt, Artificial Sequence; identical to SEQ ID NO: 206995
  derived and/or modified sequence opt5 from neuraminidase__InfluenzaA__AHC60326

SEQ ID NO: 207163 - RNA, 1410 nt, Artificial Sequence
  derived and/or modified sequence opt5 from neuraminidase__InfluenzaA__AHC60338
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacggggaugacguuuggaugggacgcacgaucaacgagacaagcagacugggcuaugagaccuuuaaggugaucgaaggguggucuaaucccaaauccaagcuccagauuaaccggcaggucaucguggaucgcggagacagaagcggcuacucuggcauuuucuccgucgaggggaaaagcuguaucaaucggugcuuuuauguggaacugauuagaggacgcaaggaggaaaccgagguucuguggacauccaacucuaucguggucuucuguggcaccagcgggacauacggaacgggcuccuggccugauggggcugaccucaaucugaugcccauuuga

SEQ ID NO: 207164 - RNA, 1410 nt, Artificial Sequence; identical to SEQ ID NO: 203908
  derived and/or modified sequence opt5 from neuraminidase__InfluenzaA__AHC60350

SEQ ID NO: 207165 - RNA, 1410 nt, Artificial Sequence
  derived and/or modified sequence opt5 from neuraminidase__InfluenzaA__AHC60362
augaaccccaaucagaagaucauuaccaucggcagcgugucccugacaauuucuacgaucugcuucuuuaugcaagucgccauucucaucaccacaguuacccugcacuucaaacaguacgaguuuaacagcccuccgaauaaccaggugaugcuuuguaagcccacaaucauugaaagaaauaucaccgagauuguguaucugacaaacaccacgaucgaaaaagagauuugcccuaagcucgcugaauaccggaauugguccaaaccccagugugacaucaccggguucgccccuuuuucuaaggauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugagcugggcguccccuuucaccucgggaccaaacaggugugcaucgccugguccagcagcuccugucaugacggaaaggccuggcugcacguuugcauuacaggcgaugacaaaaacgcuaccgccagcuucaucuacaauggcaaacuuguggauucugucguguccuggagcaaggaaauucugcggacccaggagucugaaugugugugcaucaacgggacauguacggucguuaugaccgacggauccgcuagcggcaaggccgauacaaagauucucuuuaucgaggaggggaaaaucgugcauaccuccacacugucuggaagcgcgcaacacguggaagagugcuccugcuauccucgcuaccccggcgucagaugugugugccgggacaacuggaaggggagcaaucgcccuauuguugauaucaacauuaaagaccacucuaucguguccagcuacgucuguucuggacuugugggcgacacccccagaaagaaugauagcuccucuagcucccauugccuggacccgaacaaugaagagggcgggcacggaguuaaaggcugggccuucgaugacgggaacgauguguggaugggacggacgauuaaugaaacaagccgccucggcuaugagaccuuuaaggucaucgagggguggucuaacccuaaauccaagcugcagaucaauagacaggugauugucgaccggggaaaccgcagcggcuacucuggcaucuucuccguggaagggaagucuuguauuaauagaugcuuuuauguugagcugauccggggaagaaaagaagagaccgaagugcucuggacauccaacucuauugucguguucuguggcaccagcgggacauacggaacgggcuccuggcccgauggggcugaccugaaucuuaugccuaucuga

SEQ ID NO: 207166 - RNA, 1410 nt, Artificial Sequence; identical to SEQ ID NO: 206907
  derived and/or modified sequence opt5 from neuraminidase__InfluenzaA__AHC60374

SEQ ID NO: 207167 - RNA, 1410 nt, Artificial Sequence; identical to SEQ ID NO: 202542
  derived and/or modified sequence opt5 from neuraminidase__InfluenzaA__AHC60386

SEQ ID NO: 207168 - RNA, 1410 nt, Artificial Sequence; identical to SEQ ID NO: 206999
  derived and/or modified sequence opt5 from neuraminidase__InfluenzaA__AHC60398

SEQ ID NO: 207169 - RNA, 1410 nt, Artificial Sequence; identical to SEQ ID NO: 207031
  derived and/or modified sequence opt5 from neuraminidase__InfluenzaA__AHC60410

SEQ ID NO: 207170 - RNA, 1410 nt, Artificial Sequence; identical to SEQ ID NO: 202542
  derived and/or modified sequence opt5 from neuraminidase__InfluenzaA__AHC60422

SEQ ID NO: 207171 - RNA, 1410 nt, Artificial Sequence; identical to SEQ ID NO: 207031
  derived and/or modified sequence opt5 from neuraminidase__InfluenzaA__AHC60434

SEQ ID NO: 207172 - RNA, 1410 nt, Artificial Sequence; identical to SEQ ID NO: 206999
  derived and/or modified sequence opt5 from neuraminidase__InfluenzaA__AHC60446

SEQ ID NO: 207173 - RNA, 1410 nt, Artificial Sequence
  derived and/or modified sequence opt5 from neuraminidase__InfluenzaA__AHC60458
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacaugugcuguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauggcagcuccucuagccauugccuggacccgaacaaugaggaagggggacacggcgugaaagggugggcuuucgaugacggaaacgauguuuggaugggccgcaccaucaaugagacguccagacucggguaugagacauuuaaggugaucgaaggauggagcaacccuaaaucuaagcugcagauuaaucggcaggucaucguggaccgcggcaacagauccggcuacagcgggauuuucucugucgagggaaaauccuguaucaaucggugcuuuuauguggaacugauuagaggccgcaaggaggaaaccgagguucucuggaccagcaacuccaucguggucuucugugggacaucuggaaccuacggcacagggagcuggcccgauggcgccgaccugaaucuuaugccuauuuga

SEQ ID NO: 207174 - RNA, 1410 nt, Artificial Sequence; identical to SEQ ID NO: 207044
  derived and/or modified sequence opt5 from neuraminidase__InfluenzaA__AHC60470

SEQ ID NO: 207175 - RNA, 1410 nt, Artificial Sequence
  derived and/or modified sequence opt5 from neuraminidase__InfluenzaA__AHC60482
augaaccccaaucagaagaucauuaccaucggcagcgugucccugacaauuucuacgaucugcuucuuuaugcaaauugccauccucaccacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacccgcugaguaccggaauugguccaagccucagugugacaucacaggguucgcccccuuuucuaaagauaacagcauucgccucuccgcgggaggcgacaucugggugaccagagagccuuaugucucuugcgauccggacaaguguuaccaauucgcucuggggcagggaacaacccuuaauaacgugcauagcaauaacacgguucgggaucgcacacccuauagaacccugcucaugaaugaacugggcgugccuuuucaccuggggacaaagcaggucugcaucgccugguccucuagcuccugucaugacggaaaagccuggcuccacgugugcauuaccggcgaugacaagaacgcuaccgccagcuucaucuacaauggccggcugguugauucuguggucuccuggagcaaagagauucuucgcacacaggaaucugagugugugugcaucaacgggacguguaccguggucaugacagacggauccgcuagcggcaaggccgauaccaaaauucuguuuaucgaggaagggaagaucguucauacauccacccucucuggaagcgcgcaacacguggaggaaugcuccugcuaucccagauacccuggcgugcggugugucugccgcgacaacuggaaggggagcaauagacccauuguggauaucaacauuaaagaccacucuaucguuuccagcuacguguguucuggacuggucggcgacacgccgcggaagaaugauagcuccucuagcucccauugccuugacccuaacaaugaggaaggcgggcacggagugaaaggcugggccuucgaugacgggaacgauguuuggaugggacgcacaauuaaugagaccagcagacugggcuaugagaccuuuaaggugaucgaaggguggucuaaccccaaauccaagcuccagaucaaucggcaggucauuguggaccgcggagauagaagcggcuacucuggcaucuucuccgucgaggggaaaagcuguauuaaccggugcuuuuauguggaacugaucagaggacgcaaggaggaaacagagguucuguggaccuccaauucuauuguggucuucuguggcacaagcgggacguacggaaccggcuccuggccugacggggcugaucucaaccugaugcccaucuga

SEQ ID NO: 207176 - RNA, 1410 nt, Artificial Sequence; identical to SEQ ID NO: 206995
  derived and/or modified sequence opt5 from neuraminidase__InfluenzaA__AHC60494

SEQ ID NO: 207177 - RNA, 1410 nt, Artificial Sequence; identical to SEQ ID NO: 206995
  derived and/or modified sequence opt5 from neuraminidase__InfluenzaA__AHC60506

SEQ ID NO: 207178 - RNA, 1410 nt, Artificial Sequence; identical to SEQ ID NO: 206999
  derived and/or modified sequence opt5 from neuraminidase__InfluenzaA__AHC60518

SEQ ID NO: 207179 - RNA, 1410 nt, Artificial Sequence; identical to SEQ ID NO: 206999
  derived and/or modified sequence opt5 from neuraminidase__InfluenzaA__AHC60542

SEQ ID NO: 207180 - RNA, 1410 nt, Artificial Sequence
  derived and/or modified sequence opt5 from neuraminidase__InfluenzaA__AHC60554
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaaugauugagagaaacaucaccgaaauuguguaccugacaaauaccacgaucgagaaggaaauuugcccuaaacucgcugaguaucggaacugguccaagccccagugugacaucaccggguucgccccuuuuucuaaagauaauagcauucgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcaucgccugguccucuagcuccugucaugacggaaaagccuggcugcacgugugcauuacaggcgaugacaagaaugcuaccgccagcuucaucuauaacggccggcuuguugauucuguggucuccuggagcaaagagauucugcgcacccaggaaucugagugugugugcaucaaugggacauguacgguggucaugaccgacggauccgcuagcggcaaggccgauacaaaaauucucuuuaucgaggaagggaagaucguucauaccuccacacugucuggaagcgcgcaacacguggaggaaugcuccugcuacccuagauaccccggcgugcggugugucugccgcgacaacuggaaggggagcaacagaccuauuguggauaucaauauuaaagaccacucuaucguuuccagcuauguguguucuggacuugucggcgacacgccccggaagaacgauagcuccucuagcucccauugccuggacccgaauaacgaggaaggcgggcacggagugaaaggcugggccuucgaugacgggaaugauguuuggaugggacgcaccauuaacgagacaagcagacucggcuacgagaccuuuaaggugaucgaaggguggucuaauccuaaauccaagcugcagaucaaccggcaggucauuguggaccgcggaaauagaagcggcuauucuggcaucuucuccgucgaggggaaaagcuguauuaaccggugcuuuuacguggaacugaucagaggacgcaaggaggaaaccgagguucucuggacauccaauucuauuguggucuucuguggcaccagcgggacauauggaacgggcaccuggcccgauggggcugaccugaaccuuaugccuaucuga

SEQ ID NO: 207181 - RNA, 1410 nt, Artificial Sequence
  derived and/or modified sequence opt5 from neuraminidase__InfluenzaA__AHC60566
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccaggucaaucgccaggugauugucgaccggggagauagaagcggcuacucuggcaucuucuccguggaggggaaaagcuguauuaaccggugcuuuuauguugaacugaucagaggacgcaaggaggaaaccgaggugcuguggacauccaauucuauugucguguucuguggcaccagcgggacauacggaacgggcuccuggccugacggggcugaucucaaccugaugcccaucuga

SEQ ID NO: 207182 - RNA, 1410 nt, Artificial Sequence; identical to SEQ ID NO: 205946
  derived and/or modified sequence opt5 from neuraminidase__InfluenzaA__AHC60578

SEQ ID NO: 207183 - RNA, 1410 nt, Artificial Sequence; identical to SEQ ID NO: 206995
  derived and/or modified sequence opt5 from neuraminidase__InfluenzaA__AHC60590

SEQ ID NO: 207184 - RNA, 1410 nt, Artificial Sequence
  derived and/or modified sequence opt5 from neuraminidase__InfluenzaA__AHC60602
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguugugcuuugugaaccuacaauuaucgagagaaauauuaccgaaaucguguaucugacaaacaccacgauugagaaggaaaucugccccaaaccugcugaguaccggaauuggagcaagccccagugugacauuaccggguucgccccuuuuuccaaagauaacucuauccgccucagcgcgggaggcgacaucugggucacaagagagccguauguguccugcgaucccgacaaguguuaccaauucgcucuggggcagggaaccacacuuaauaacguucauucuaauaacaccgugcgggaucgcacgccuuauagaacacugcucaugaaugaacugggcguccccuuucaccuggggaccaaacaggugugcauugccuggagcuccagcucuugucaugacggaaaggccuggcuccacguuugcaucacaggcgaugacaagaacgcuaccgccuccuucauuuacaauggccggcugguggauagcgucgugucuugguccaaagagauccuucgcacccaggaaagcgagugugugugcauuaacgggacauguacggucguuaugaccgacggaucugcuuccggcaaggccgauacaaaaauccuguuuaucgaggaagggaagauugugcauaccagcacacucuccggaucugcgcaacacguggaggaaugcagcugcuauccuagauaccccggcguccggugugugugccgcgacaacuggaagggguccaauagaccgaucguugauauuaacaucaaagaccacagcauugugucuuccuacgucuguagcggacuggugggcgacaccccucggaagaaugauucuagcuccucuagccauugccuugaccccaacaaugaggaaggcgggcacggaguuaaaggcugggccuucgaugacgggaacgauguguggaugggacgcacgaucaaugagacauccagacugggcuaugagaccuuuaaggucaucgaaggguggagcaacccuaaaucuaagcuccagauuaaucgccaggugaucgucgaccggggagauagauccggcuacagcggcauuuucucuguggaggggaaauccuguaucaaccggugcuuuuauguugaacugauuagaggacgcaaggaggaaaccgaggugcuguggacaagcaauuccaucgucguguucuguggcaccucugggacauacggaacgggcagcuggcccgacggggcugaucucaaccugaugcccauuuga

SEQ ID NO: 207185 - RNA, 1410 nt, Artificial Sequence; identical to SEQ ID NO: 202542
  derived and/or modified sequence opt5 from neuraminidase__InfluenzaA__AHC60614

SEQ ID NO: 207186 - RNA, 1410 nt, Artificial Sequence; identical to SEQ ID NO: 205946
  derived and/or modified sequence opt5 from neuraminidase__InfluenzaA__AHC60626

SEQ ID NO: 207187 - RNA, 1410 nt, Artificial Sequence
  derived and/or modified sequence opt5 from neuraminidase__InfluenzaA__AHC60650
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccagcagcuccugucaugacggaaaagccuggcugcacgugugcaucacaggcgaugacgagaaugcuaccgccagcuucauuuauaacggccggcuuguugauucuguggucuccuggagcaaggaaauccugcgcacccaggagucugagugugugugcauuaaugggacauguacgguggucaugaccgacggauccgcuagcggcaaagccgauacaaagauccucuuuaucgaagaggggaaaauuguucauaccuccacacugucuggaagcgcgcaacacguggaagagugcuccugcuacccuagauaccccggcgugcggugugucugccgcgacaacuggaaggggagcaacagaccuaucguggauauuaauaucaaggaccacucuauuguuuccagcuauguguguucuggacuugucggcgacacgccccggaaaaacgauagcuccucuagcucccauugccuggacccgaauaacgaagagggcgggcacggagugaagggcugggccuucgaugacgggaaugauguuuggaugggacgcaccaucaacgagacaagcagacucggcuacgaaaccuuuaaagugaucgagggguggucuaauccuaaguccaaacugcagauuaaccggcaggucaucguggaccgcggaaauagaagcggcuauucuggcauuuucuccgucgaagggaagucuuguaucaaccggugcuuuuacguggagcugauuagaggacgcaaagaagagaccgagguucucuggacauccaauucuaucguggucuucuguggcaccagcgggacauauggaacgggcuccuggcccgauggggcugaccugaaccuuaugccuauuuga

SEQ ID NO: 207188 - RNA, 1410 nt, Artificial Sequence; identical to SEQ ID NO: 207044
  derived and/or modified sequence opt5 from neuraminidase__InfluenzaA__AHC60662

SEQ ID NO: 207189 - RNA, 1410 nt, Artificial Sequence; identical to SEQ ID NO: 206999
  derived and/or modified sequence opt5 from neuraminidase__InfluenzaA__AHC60674

SEQ ID NO: 207190 - RNA, 1410 nt, Artificial Sequence; identical to SEQ ID NO: 202542
  derived and/or modified sequence opt5 from neuraminidase__InfluenzaA__AHC60686

SEQ ID NO: 207191 - RNA, 1410 nt, Artificial Sequence; identical to SEQ ID NO: 206999
  derived and/or modified sequence opt5 from neuraminidase__InfluenzaA__AHC60698

SEQ ID NO: 207192 - RNA, 1410 nt, Artificial Sequence; identical to SEQ ID NO: 206995
  derived and/or modified sequence opt5 from neuraminidase__InfluenzaA__AHC60710

SEQ ID NO: 207193 - RNA, 1410 nt, Artificial Sequence; identical to SEQ ID NO: 207044
  derived and/or modified sequence opt5 from neuraminidase__InfluenzaA__AHC60722

SEQ ID NO: 207194 - RNA, 1410 nt, Artificial Sequence
  derived and/or modified sequence opt5 from neuraminidase__InfluenzaA__AHC60734
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugauuaacacaaccaucgagaaggaaauuugcccuaaacucgcugaguaccggaauugguccaagccccagugugacaucacgggguucgccccuuuuucuaaagauaacagcauccgccuguccgcgggaggcgacauuugggugaccagagagcccuaugucucuugcgauccuaauaaguguuaccaauucgcucuugggcagggaacaacccugaacaaugugcauagcaacaauacaguucgggaccgcaccccguauagaacgcuccugaugaacgaacugggcgugcccuuucaccucgggacaaagcaggucugcaucgccugguccucuagcuccugucaugauggaaaagccuggcugcacgugugcauuaccggcgacgauaagaaugcuacagccagcuucaucuacaacggcaaacuuguugacucuguggucuccuggagcaaggagauucugcggacccaggaaucugagugugugugcaucaacgggaccuguacaguggucaugacggauggauccgcuagcggcaaagccgacaccaagauccucuuuauugaggaagggaagaucguucauacauccacccugucuggaagcgcgcaacacguggaggaaugcuccugcuauccucgcuaccccggcgugagaugugucugccgggauaauuggaaagggagcaaccgcccuauuguggacaucaauauuaaggaucacucuaucguuuccagcuacguguguucuggacuugucggcgacacacccagaaagaacgacagcuccucuagcucccauugccuggauccgaauaacgaggaaggcgggcacggagugaagggcugggccuucgacgaugggaaugacguuuggaugggacggaccaucaacgagacgagccgccucggcuaugagacauuuaaagugauugaaggguggucuaauccuaaguccaaacugcagaucaacagacaggucauuguggaucggggaaaucgcagcggcuacucuggcaucuucuccgucgaggggaaaagcuguauuaacagaugcuuuuauguggaacugauccggggaagaaaggaggaaaccgagguucucuggaccuccaauucuauuguggucuucuguggcacaagcgggaccuacggaacaggcuccuggcccgacggggcugaucugaaccuuaugccuaucuga

SEQ ID NO: 207195 - RNA, 1410 nt, Artificial Sequence; identical to SEQ ID NO: 207031
  derived and/or modified sequence opt5 from neuraminidase__InfluenzaA__AHC60746

SEQ ID NO: 207196 - RNA, 1410 nt, Artificial Sequence; identical to SEQ ID NO: 207130
  derived and/or modified sequence opt5 from neuraminidase__InfluenzaA__AHC60770

SEQ ID NO: 207197 - RNA, 1410 nt, Artificial Sequence
  derived and/or modified sequence opt5 from neuraminidase__InfluenzaA__AHC60782
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccggauacguguguagcggccuugucggcgacacgccccggaagaaugauucuagcuccucuagccauugccuggacccgaacaaugaggaagggggacacggcgugaaagggugggccuucgaugacggaaacgauguuuggaugggccgcaccaucaaugagacauccagacucggguaugagaccuuuaaggugaucgaaggauggagcaacccuaaaucuaagcugcagauuaaucggcaggucaucguggaccgcggcaacagauccggcuacagcgggauuuucucugucgagggaaaauccuguaucaaucggugcuuuuauguggaacugauuagaggccgcaaggaggaaaccgagguucucuggacaagcaacuccaucguggucuucugugggaccucuggaacauacggcacggggagcuggcccgauggcgcugaccugaaucuuaugccuauuuga

SEQ ID NO: 207198 - RNA, 1410 nt, Artificial Sequence; identical to SEQ ID NO: 207042
  derived and/or modified sequence opt5 from neuraminidase__InfluenzaA__AHC60794

SEQ ID NO: 207199 - RNA, 1410 nt, Artificial Sequence
  derived and/or modified sequence opt5 from neuraminidase__InfluenzaA__AHC60806
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccuaauaagugcuaucaauucgcucuugggcagggaaccacacugaacaaugugcauagcaacaauaccguucgggaccgcacgccguacagaacacuccugaugaacgaacugggcgugcccuuucaccucgggaccaagcaggucuguauugccugguccucuagcuccugccaugauggaaaagccuggcugcacguguguaucacaggcgacgauaagaaugcuaccgccagcuucauuuauaacggcaaacuuguugacucuguggucuccuggagcaaggagauccugcggacccaggaaucugagugcguguguauuaacgggacaugcacgguggucaugaccgauggauccgcuagcggcaaagccgacacaaagauccucuuuaucgaggaagggaagauuguucauaccuccacacugucuggaagcgcgcaacacguggaggaaugcuccuguuacccucgcuaucccggcgugagaugcgucugucgggauaauuggaaagggagcaaccgcccuaucguggacauuaauaucaaggaucacucuauuguuuccagcuacgugugcucuggacuugucggcgacacccccagaaagaacgacagcuccucuagcucccauugucuggauccgaauaacgaggaaggcgggcacggagugaagggcugggccuucgacgaugggaaugacguuuggaugggacggacgaucaacgagacaagccgccucggcuacgagaccuuuaaagugaucgaaggguggucuaauccuaaguccaaacugcagauuaacagacaggucaucguggaucggggaaaucgcagcggcuauucuggcauuuucuccgucgaggggaaaagcugcaucaacagauguuuuuacguggaacugauucggggaagaaaggaggaaaccggcguucucuggacauccaauucuaucguggucuucugcgggaccagcggaacauauggcacgggguccuggcccgacggcgcugaucugaaccuuaugccuauuuga

SEQ ID NO: 207200 - RNA, 1410 nt, Artificial Sequence; identical to SEQ ID NO: 203908
  derived and/or modified sequence opt5 from neuraminidase__InfluenzaA__AHC60818

SEQ ID NO: 207201 - RNA, 1410 nt, Artificial Sequence; identical to SEQ ID NO: 206999
  derived and/or modified sequence opt5 from neuraminidase__InfluenzaA__AHC60830

SEQ ID NO: 207202 - RNA, 1410 nt, Artificial Sequence; identical to SEQ ID NO: 207180
  derived and/or modified sequence opt5 from neuraminidase__InfluenzaA__AHC60842

SEQ ID NO: 207203 - RNA, 1410 nt, Artificial Sequence; identical to SEQ ID NO: 206999
  derived and/or modified sequence opt5 from neuraminidase__InfluenzaA__AHC60854

SEQ ID NO: 207204 - RNA, 1410 nt, Artificial Sequence; identical to SEQ ID NO: 207044
  derived and/or modified sequence opt5 from neuraminidase__InfluenzaA__AHC60866

SEQ ID NO: 207205 - RNA, 1410 nt, Artificial Sequence; identical to SEQ ID NO: 207031
  derived and/or modified sequence opt5 from neuraminidase__InfluenzaA__AHC60878

SEQ ID NO: 207206 - RNA, 1410 nt, Artificial Sequence; identical to SEQ ID NO: 207031
  derived and/or modified sequence opt5 from neuraminidase__InfluenzaA__AHC60890

SEQ ID NO: 207207 - RNA, 1410 nt, Artificial Sequence; identical to SEQ ID NO: 207130
  derived and/or modified sequence opt5 from neuraminidase__InfluenzaA__AHC60902

SEQ ID NO: 207208 - RNA, 1410 nt, Artificial Sequence; identical to SEQ ID NO: 206995
  derived and/or modified sequence opt5 from neuraminidase__InfluenzaA__AHC60914

SEQ ID NO: 207209 - RNA, 1410 nt, Artificial Sequence; identical to SEQ ID NO: 206999
  derived and/or modified sequence opt5 from neuraminidase__InfluenzaA__AHC60926

SEQ ID NO: 207210 - RNA, 1410 nt, Artificial Sequence; identical to SEQ ID NO: 206995
  derived and/or modified sequence opt5 from neuraminidase__InfluenzaA__AHC60938

SEQ ID NO: 207211 - RNA, 1410 nt, Artificial Sequence; identical to SEQ ID NO: 206999
  derived and/or modified sequence opt5 from neuraminidase__InfluenzaA__AHC60950

SEQ ID NO: 207212 - RNA, 1410 nt, Artificial Sequence
  derived and/or modified sequence opt5 from neuraminidase__InfluenzaA__AHC60962
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaauuaucgagagaaacauuaccgaaaucguguaccugacaaauaccacgauugagaaggaaaucugcccuaaacucgcugaguaucggaacugguccaagccccagugugacauuaccggguucgccccuuuuucuaaagauaauagcauccgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcauugccugguccucuagcuccugucaugacggaaaagccuggcugcacgugugcguuacaggcgaugacaagaaugcuaccgccagcuucaucuauaacggccggcuuguggauucugucguguccuggagcaaagagauucugcgcacccaggaaucugagugugugugcaucaaugggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuacccuagauaccccggcguccggugugugugccgcgacaacuggaaggggagcaacagaccuauuguugauaucaauauuaaagaccacucuaucguguccagcuaugucuguucuggacuugugggcgacacgccccggaagaacgauagcuccucuagcucccauugccuggacccgaauaacgaggaaggcgggcacggaguuaaaggcugggccuucgaugacgggaaugauguguggaugggacgcaccauuaacgagacaagcagacucggcuacgagaccuuuaaggucaucgaaggguggucuaauccuaaauccaagcugcagaucaaccgccaggugauugucgaccggggaaauagaagcggcuauucuggcaucuucuccguggaggggaaaagcuguauuaaccggugcuuuuacguugaacugaucagaggacgcaaggaggaaaccgaggugcucuggacauccaauucuauugucguguucuguggcaccagcgggacauauggaacgggcuccuggcccgauggggcugaccugaaccuuaugccuaucuga

SEQ ID NO: 207213 - RNA, 1410 nt, Artificial Sequence; identical to SEQ ID NO: 207044
  derived and/or modified sequence opt5 from neuraminidase__InfluenzaA__AHC60974

SEQ ID NO: 207214 - RNA, 1410 nt, Artificial Sequence; identical to SEQ ID NO: 206995
  derived and/or modified sequence opt5 from neuraminidase__InfluenzaA__AHC60986

SEQ ID NO: 207215 - RNA, 1410 nt, Artificial Sequence; identical to SEQ ID NO: 207142
  derived and/or modified sequence opt5 from neuraminidase__InfluenzaA__AHC60998

SEQ ID NO: 207216 - RNA, 1410 nt, Artificial Sequence; identical to SEQ ID NO: 207042
  derived and/or modified sequence opt5 from neuraminidase__InfluenzaA__AHC61010

SEQ ID NO: 207217 - RNA, 1410 nt, Artificial Sequence
  derived and/or modified sequence opt5 from neuraminidase__InfluenzaA__AHC61022
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuaucagccauugccuggacccgaacaaugaggaaggcgggcacggagugaaaggcugggccuucgaugacgggaacgauguuuggaugggacgcaccaucaaugagacauccagacucggcuaugagaccuuuaaggugauugaaggguggagcaacccuaaaucuaagcugcagaucaaucggcaggucauuguggaccgcggaaacagauccggcuacagcggcaucuucucugucgaggggaaauccuguauuaaucggugcuuuuauguggaacugaucagaggacgcaaggaggaaaccgagguucucuggacaagcaacuccauuguggucuucuguggcaccucugggacauacggaacgggcagcuggcccgauggggcugaccugaaucuuaugccuaucuga

SEQ ID NO: 207218 - RNA, 1410 nt, Artificial Sequence; identical to SEQ ID NO: 202542
  derived and/or modified sequence opt5 from neuraminidase__InfluenzaA__AHC61034

SEQ ID NO: 207219 - RNA, 1410 nt, Artificial Sequence; identical to SEQ ID NO: 206995
  derived and/or modified sequence opt5 from neuraminidase__InfluenzaA__AHC61046

SEQ ID NO: 207220 - RNA, 1410 nt, Artificial Sequence; identical to SEQ ID NO: 207044
  derived and/or modified sequence opt5 from neuraminidase__InfluenzaA__AHC61058

SEQ ID NO: 207221 - RNA, 1410 nt, Artificial Sequence; identical to SEQ ID NO: 206907
  derived and/or modified sequence opt5 from neuraminidase__InfluenzaA__AHC61070

SEQ ID NO: 207222 - RNA, 1410 nt, Artificial Sequence
  derived and/or modified sequence opt5 from neuraminidase__InfluenzaA__AHC61082
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcauugccugguccucuagcuccugucaugacggaaaggccuggcuccacguuugcaucacaggcgaugacaagaacgcuaccgccagcuucauuuacaauggccggcugguggauucugucguguccuggagcaaagagauccuucgcacccaggaaucugagugugugugcauuaacgggacauguacggucguuaugaccgacggauccgcuagcggcaaggccgauacaaaaauccuguuuaucgaggaagggaagauugugcauaccuccacacucucuggaagcgcgcaacacguggaggaaugcuccugcuaucccagauacccuggcguccggugugugugccgcgacaacuggaaggggagcaauagacccaucguugauauuaacaucaaagaccacucuauuguguccagcuacgucuguucuggacuggugggcgacaccccgcggaagaaugauagcuccucuagcucccauugccuugacccuaacaaugaggaaggcgggcacggaguuaaaggcugggccuucgaugacgggaacgauguguggaugggacgcacgaucaaugagacaagcagacugggcuaugagaccuuuaaggucaucgaaggguggucuaaccccaaauccaagcuccagauuaaucgccaggugaucgucgaccggggagauagaagcggcuacucuggcauuuucuccguggaggggaaaagcuguaucaaccggugcuuuuauguugaacugauuagaggacgcaaggaggaaaccggcgugcuguggacauccaauucuaucgucguguucugugggaccagcggaacauacggcacgggguccuggccugacggcgcugaucucaaccugaugcccauuuga

SEQ ID NO: 207223 - RNA, 1410 nt, Artificial Sequence; identical to SEQ ID NO: 202542
  derived and/or modified sequence opt5 from neuraminidase__InfluenzaA__AHC61094

SEQ ID NO: 207224 - RNA, 1410 nt, Artificial Sequence; identical to SEQ ID NO: 207031
  derived and/or modified sequence opt5 from neuraminidase__InfluenzaA__AHC61106

SEQ ID NO: 207225 - RNA, 1410 nt, Artificial Sequence; identical to SEQ ID NO: 207031
  derived and/or modified sequence opt5 from neuraminidase__InfluenzaA__AHC61118

SEQ ID NO: 207226 - RNA, 1410 nt, Artificial Sequence; identical to SEQ ID NO: 206995
  derived and/or modified sequence opt5 from neuraminidase__InfluenzaA__AHC61130

SEQ ID NO: 207227 - RNA, 1410 nt, Artificial Sequence; identical to SEQ ID NO: 207142
  derived and/or modified sequence opt5 from neuraminidase__InfluenzaA__AHC61142

SEQ ID NO: 207228 - RNA, 1410 nt, Artificial Sequence; identical to SEQ ID NO: 207031
  derived and/or modified sequence opt5 from neuraminidase__InfluenzaA__AHC61154

SEQ ID NO: 207229 - RNA, 1410 nt, Artificial Sequence
  derived and/or modified sequence opt5 from neuraminidase__InfluenzaA__AHC61166
augaaccccaaucagaagaucauuaccaucggcagcgugucccugacaauuucuacgaucugcuucuuuaugcaagucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccagcagcuccugucaugacggaaaagccuggcugcacguuugcauuacaggcgaugacaagaacgcuaccgccagcuucaucuacaauggcaaacuuguggauucugucguguccuggagcaaggagauucugcggacccaggaaucugagugugugugcaucaacgggacauguacggucguuaugaccgacggauccgcuagcggcaaagccgauacaaagauucucuuuaucgaggaagggaagaucgugcauaccuccacacugucuggaagcgcgcaacacguggaggaaugcuccugcuauccucgcuaccccggcgucagaugugugugccgggacaacuggaaagggagcaaucgcccuauuguugauaucaacauuaaggaccacucuaucguguccagcuacgucuguucuggacuugugggcgacacccccagaaagaaugauagcuccucuagcucccauugccuggacccgaacaaugaggaaggcgggcacggaguuaagggcugggccuucgaugacgggaacgauguguggaugggacggacgauuaaugagacaagccgccucggcuaugagaccuuuaaagucaucgaaggguggucuaacccuaaguccaaacugcagaccaauagacaggugaucgucgaccggggaaaccgcagcggcuacucuggcauuuucuccguggaggggaagucuuguaucaauagaugcuuuuauguugaacugauucggggaagaaaggaggaaacagaggugcucuggaccuccaacucuaucgucguguucuguggcacaagcgggacguacggaaccggcuccuggcccgauggggcugaccugaaucuuaugccuauuuga

SEQ ID NO: 207230 - RNA, 1410 nt, Artificial Sequence; identical to SEQ ID NO: 206995
  derived and/or modified sequence opt5 from neuraminidase__InfluenzaA__AHC61178

SEQ ID NO: 207231 - RNA, 1410 nt, Artificial Sequence; identical to SEQ ID NO: 207031
  derived and/or modified sequence opt5 from neuraminidase__InfluenzaA__AHC61190

SEQ ID NO: 207232 - RNA, 1410 nt, Artificial Sequence; identical to SEQ ID NO: 207044
  derived and/or modified sequence opt5 from neuraminidase__InfluenzaA__AHC61202

SEQ ID NO: 207233 - RNA, 1410 nt, Artificial Sequence; identical to SEQ ID NO: 206999
  derived and/or modified sequence opt5 from neuraminidase__InfluenzaA__AHC61214

SEQ ID NO: 207234 - RNA, 1410 nt, Artificial Sequence; identical to SEQ ID NO: 207044
  derived and/or modified sequence opt5 from neuraminidase__InfluenzaA__AHC61226

SEQ ID NO: 207235 - RNA, 1410 nt, Artificial Sequence; identical to SEQ ID NO: 207031
  derived and/or modified sequence opt5 from neuraminidase__InfluenzaA__AHC61238

SEQ ID NO: 207236 - RNA, 1410 nt, Artificial Sequence; identical to SEQ ID NO: 207212
  derived and/or modified sequence opt5 from neuraminidase__InfluenzaA__AHC61250

SEQ ID NO: 207237 - RNA, 1410 nt, Artificial Sequence; identical to SEQ ID NO: 206995
  derived and/or modified sequence opt5 from neuraminidase__InfluenzaA__AHC61262

SEQ ID NO: 207238 - RNA, 1410 nt, Artificial Sequence; identical to SEQ ID NO: 206999
  derived and/or modified sequence opt5 from neuraminidase__InfluenzaA__AHC61274

SEQ ID NO: 207239 - RNA, 1410 nt, Artificial Sequence; identical to SEQ ID NO: 202542
  derived and/or modified sequence opt5 from neuraminidase__InfluenzaA__AHC61286

SEQ ID NO: 207240 - RNA, 1410 nt, Artificial Sequence; identical to SEQ ID NO: 207043
  derived and/or modified sequence opt5 from neuraminidase__InfluenzaA__AHC61298

SEQ ID NO: 207241 - RNA, 1410 nt, Artificial Sequence
  derived and/or modified sequence opt5 from neuraminidase__InfluenzaA__AHC61310
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcgggcacggagugaagggcugggccuucgacgaugggaaugacguuuggaugggacggacgaucaacgagacaagccgccucggcuaugagaccuuuaaagugaucgaaggguggucuaauccuaaguccaaacugcagauuaacagacaggucaucauugaucggggaaaucgcagcggcuacucuggcaucuucuccguggaggggaaaagcuguauuaacagaugcuuuuaugucgaacugauccggggaagaaaggaggaaaccgaggugcucuggacauccucuagcauuguuguguucuguggcaccuccgggacauacggaacgggcucuuggcccgacggggcugaucugaaucuuaugccuaucuga

SEQ ID NO: 207242 - RNA, 1410 nt, Artificial Sequence; identical to SEQ ID NO: 207072
  derived and/or modified sequence opt5 from neuraminidase__InfluenzaA__AHC61322

SEQ ID NO: 207243 - RNA, 1410 nt, Artificial Sequence; identical to SEQ ID NO: 207031
  derived and/or modified sequence opt5 from neuraminidase__InfluenzaA__AHC61334

SEQ ID NO: 207244 - RNA, 1410 nt, Artificial Sequence; identical to SEQ ID NO: 206999
  derived and/or modified sequence opt5 from neuraminidase__InfluenzaA__AHC61346

SEQ ID NO: 207245 - RNA, 1410 nt, Artificial Sequence
  derived and/or modified sequence opt5 from neuraminidase__InfluenzaA__AHC61358
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauaucagcuccucuagccauugccuggacccgaacaaugaggaaggcgggcacggagugaaaggcugggccuucgaugacgggaacgauguuuggaugggacgcaccaucaaugagacauccagacucggcuaugagaccuuuaaggugauuaaaggguggagcaacccuaagucuaaacugcagaucaaucggcaggucauuguggaccgcggaaacagauccggcuacagcggcaucuucucugucgaagggaaguccuguauuaaucggugcuuuuauguggagcugaucagaggacgcaaggaagagaccgaaguucucuggacaagcaacuccauuguggucuucuguggcaccucugggacauacggaacgggcagcuggcccgauggggcugaccugaaucuuaugccuaucuga

SEQ ID NO: 207246 - RNA, 1410 nt, Artificial Sequence; identical to SEQ ID NO: 207044
  derived and/or modified sequence opt5 from neuraminidase__InfluenzaA__AHC61370

SEQ ID NO: 207247 - RNA, 1410 nt, Artificial Sequence; identical to SEQ ID NO: 207072
  derived and/or modified sequence opt5 from neuraminidase__InfluenzaA__AHC61382

SEQ ID NO: 207248 - RNA, 1410 nt, Artificial Sequence; identical to SEQ ID NO: 207044
  derived and/or modified sequence opt5 from neuraminidase__InfluenzaA__AHC61394

SEQ ID NO: 207249 - RNA, 1410 nt, Artificial Sequence; identical to SEQ ID NO: 207072
  derived and/or modified sequence opt5 from neuraminidase__InfluenzaA__AHC61406

SEQ ID NO: 207250 - RNA, 1410 nt, Artificial Sequence; identical to SEQ ID NO: 207031
  derived and/or modified sequence opt5 from neuraminidase__InfluenzaA__AHC61418

SEQ ID NO: 207251 - RNA, 1410 nt, Artificial Sequence; identical to SEQ ID NO: 202542
  derived and/or modified sequence opt5 from neuraminidase__InfluenzaA__AHC61430

SEQ ID NO: 207252 - RNA, 1410 nt, Artificial Sequence; identical to SEQ ID NO: 207044
  derived and/or modified sequence opt5 from neuraminidase__InfluenzaA__AHC61442

SEQ ID NO: 207253 - RNA, 1410 nt, Artificial Sequence; identical to SEQ ID NO: 207044
  derived and/or modified sequence opt5 from neuraminidase__InfluenzaA__AHC61454

SEQ ID NO: 207254 - RNA, 1410 nt, Artificial Sequence
  derived and/or modified sequence opt5 from neuraminidase__InfluenzaA__AHC61466
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaccacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccagcagcuccugucaugacggaaaagccuggcugcacgugugcauuaccggcgaugacaagaacgcuaccgccagcuucaucuacaauggccggcuuguugauucuguggucuccuggagcaaagagauucugcgcacacaggaaucugagugugugugcaucaacgggacguguaccguggucaugacagacggauccgcuagcggcaaggccgauaccaaaauucucuuuaucgaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcacaauuaaugagaccagcagacucggcuaugagaccuuuaaggugaucgaaggguggucuaacccuaaauccaagcugcagaucaaucggcaggucauuguggacaaaggaaaccgcagcggcuacucuggcaucuucuccgucgaggggaagucuuguauuaauagaugcuuuuauguggaacugauccggggaagaaaggaggaaacagagguucucuggaccuccaacucuauuguggucuucuguggcacaagcgggacguacggaaccggcuccuggcccgauggggcugaccugaaucuuaugccuaucuga

SEQ ID NO: 207255 - RNA, 1410 nt, Artificial Sequence; identical to SEQ ID NO: 206995
  derived and/or modified sequence opt5 from neuraminidase__InfluenzaA__AHC61478

SEQ ID NO: 207256 - RNA, 1410 nt, Artificial Sequence; identical to SEQ ID NO: 207031
  derived and/or modified sequence opt5 from neuraminidase__InfluenzaA__AHC61490

SEQ ID NO: 207257 - RNA, 1410 nt, Artificial Sequence; identical to SEQ ID NO: 206995
  derived and/or modified sequence opt5 from neuraminidase__InfluenzaA__AHC61502

SEQ ID NO: 207258 - RNA, 1410 nt, Artificial Sequence; identical to SEQ ID NO: 207044
  derived and/or modified sequence opt5 from neuraminidase__InfluenzaA__AHC61514

SEQ ID NO: 207259 - RNA, 1410 nt, Artificial Sequence; identical to SEQ ID NO: 205946
  derived and/or modified sequence opt5 from neuraminidase__InfluenzaA__AHC61526

SEQ ID NO: 207260 - RNA, 1410 nt, Artificial Sequence
  derived and/or modified sequence opt5 from neuraminidase__InfluenzaA__AHC61538
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcagccacggggugaaaggaugggccuucgacgauggcaaugacguuuggauggggcggacgaucaacgagacaucucgccucggauaugagaccuuuaaagugaucgaaggcugguccaauccuaagagcaaacugcagauuaacagacaggucaucguggaucgggggaaucgcucuggauacuccggcauuuucagcgucgagggcaaguccuguaucaacagaugcuuuuauguggaacugauucgggggagaaaggaggaaaccgagguucucuggacaucuaauagcaucguggucuucuguggaaccuccggcacauacgggacgggaucuuggcccgacggcgcugaucugaaccuuaugccuauuuga

SEQ ID NO: 207261 - RNA, 1410 nt, Artificial Sequence; identical to SEQ ID NO: 207044
  derived and/or modified sequence opt5 from neuraminidase__InfluenzaA__AHC61550

SEQ ID NO: 207262 - RNA, 1410 nt, Artificial Sequence
  derived and/or modified sequence opt5 from neuraminidase__InfluenzaA__AHC61562
augaaccccaaucagaagaucauuaccaucggcagcgugucccugacaauuucuacgaucugcuucuuuaugcaaauugccauccucaucaccacagucacccugcacuucaaacaguacgaguuuuauagcccuccgaacaaucagguuaugcuuugugaacccacaaugauugagagaaacaucaccgaaauuguguaccugacaaauaccacgaucgagaaggaaauuugcccuaaacucgcugaguaucggaacugguccaagccccagugugacaucaccggguucgccccuuuuucuaaagauaauagcauucgccuguccgcgggaggcgacaucugggugacaagagagcccuacgucucuugcgauccugacaaguguuaucaauucgcucuugggcagggaaccacacugaacaaugugcauagcaacaauaccguucgggaucgcacgccguacagaacacuccugaugaacgaacugggcgugcccuuucaccucgggaccaagcaggucugcaucgccugguccucuagcuccugucaugacggaaaagccuggcugcacgugugcauuacaggcgaugacaagaaugcuaccgccagcuucaucuauaacggccggcuuguugauucuguggucuccuggagcaaagagauucugcgcacccaggaaucugagugugugugcaucaaugggacauguacgguggucaugaccgacggauccgcuagcggcaaggccgauacaaaaauucucuuuaucgaggaagggaagaucguucauaccuccacacugucuggaagcgcgcaacacguggaggaaugcuccugcuacccuagauaccccggcgugcggugugucugccgcgacaacuggaaggggagcaacagaccuauuguggauaucaauauuaaagaccacucuaucguuuccagcuauguguguucuggacuugucggcgacacgccccggaagaacgauagcuccucuagcucccauugccuggacccgaauaacgaggaaggcgggcacggagugaaaggcugggccuucgaugacgggaaugauguuuggaugggacgcaccauuaacgagacaagcagacucggcuacgagaccuuuaaggugaucgaaggguggucuaauccuaaauccaagcugcagaucaaccggcaggucauuguggaccgcggaaauagaagcggcuauucuggcaucuucuccgucgagagcaaauccuguauuaaccggugcuuuuacguggaacugaucagagggcgcaaggaggaaaccgagguucucuggacaucuaauagcauuguggucuucuguggaaccuccggcacauaugggacgggaaccuggcccgauggcgcugaccugaaccuuaugccuaucuga

SEQ ID NO: 207263 - RNA, 1410 nt, Artificial Sequence; identical to SEQ ID NO: 207043
  derived and/or modified sequence opt5 from neuraminidase__InfluenzaA__AHC61574

SEQ ID NO: 207264 - RNA, 1410 nt, Artificial Sequence; identical to SEQ ID NO: 207044
  derived and/or modified sequence opt5 from neuraminidase__InfluenzaA__AHC61586

SEQ ID NO: 207265 - RNA, 1410 nt, Artificial Sequence; identical to SEQ ID NO: 205946
  derived and/or modified sequence opt5 from neuraminidase__InfluenzaA__AHC61598

SEQ ID NO: 207266 - RNA, 1410 nt, Artificial Sequence; identical to SEQ ID NO: 206995
  derived and/or modified sequence opt5 from neuraminidase__InfluenzaA__AHC61610

SEQ ID NO: 207267 - RNA, 1410 nt, Artificial Sequence; identical to SEQ ID NO: 207043
  derived and/or modified sequence opt5 from neuraminidase__InfluenzaA__AHC61622

SEQ ID NO: 207268 - RNA, 1410 nt, Artificial Sequence; identical to SEQ ID NO: 202542
  derived and/or modified sequence opt5 from neuraminidase__InfluenzaA__AHC61634

SEQ ID NO: 207269 - RNA, 1410 nt, Artificial Sequence; identical to SEQ ID NO: 202542
  derived and/or modified sequence opt5 from neuraminidase__InfluenzaA__AHC61646

SEQ ID NO: 207270 - RNA, 1410 nt, Artificial Sequence; identical to SEQ ID NO: 202542
  derived and/or modified sequence opt5 from neuraminidase__InfluenzaA__AHC61658

SEQ ID NO: 207271 - RNA, 1410 nt, Artificial Sequence; identical to SEQ ID NO: 205946
  derived and/or modified sequence opt5 from neuraminidase__InfluenzaA__AHC61670

SEQ ID NO: 207272 - RNA, 1410 nt, Artificial Sequence; identical to SEQ ID NO: 206999
  derived and/or modified sequence opt5 from neuraminidase__InfluenzaA__AHC61682

SEQ ID NO: 207273 - RNA, 1410 nt, Artificial Sequence; identical to SEQ ID NO: 205946
  derived and/or modified sequence opt5 from neuraminidase__InfluenzaA__AHC61694

SEQ ID NO: 207274 - RNA, 1410 nt, Artificial Sequence
  derived and/or modified sequence opt5 from neuraminidase__InfluenzaA__AHC61706
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagagcacucuauuguuuccagcuacguguguucuggacuugucggcgacacgccccggaagaaugacagcuccucuagcucccauugccuggauccgaacaaugaagagggcgggcacggagugaaaggcugggccuucgacgaugggaacgacguuuggaugggacgcaccaucaaugagacaagcagacucggcuaugaaaccuuuaaggugaucgagggguggucuaacccuaaauccaagcugcagauuaaucggcaggucaucguggaucgcggaaacagaagcggcuacucuggcauuuucuccgucgaagggaaaagcuguaucaaucggugcuuuuauguggagcugauuagaggacgcaaggaagagaccgagguucucuggacauccaacucuaucguggucuucuguggcaccagcgggacauacggaacgggcuccuggcccgacggggcugaucugaaucuuaugccuauuuga

SEQ ID NO: 207275 - RNA, 1410 nt, Artificial Sequence
  derived and/or modified sequence opt5 from neuraminidase__InfluenzaA__AHC61718
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucaccgaguaucggaauugguccaagccccagugcgacauuacaggguucgcuccuuuuucuaaagauaacagcauccgccuguccgccggaggcgacaucugggugaccagagagcccuacgucucuugugauccuaauaagugcuaucaauucgcgcuugggcagggaacaacccugaacaaugugcauagcaacaauacgguucgggaccgcacaccguacagaacccuccugaugaacgaacugggcgugcccuuucaccucgggacaaagcaggucuguauugcuugguccucuagcuccugccaugauggaaaagccuggcugcacguguguaucaccggcgacgauaagaaugccaccgcuagcuucauuuauaacggcaaacuuguugacucuguggucuccuggagcaaggagauccugcggacacaggaaucugagugcguguguauuaacgggacgugcaccguggucaugacagauggauccgccagcggcaaagcugacaccaagauccucuuuaucgaggaagggaagauuguucauacauccacccugucuggaagcgcccaacacguggaggaaugcuccuguuacccucgcuaucccggcgugagaugcgucugucgggauaauuggaaagggagcaaccgcccuaucguggacauuaauaucaaggaucacucuauuguuuccagcuacgugugcucuggacuugucggcgacacgcccagaaagaacgacagcuccucuagcucccauugucuggauccgaauaacgaggaaggcgggcacggagugaagggcugggcguucgacgaugggaaugacguuuggaugggacggacaaucaacgagaccagccgccucggcuacgagaccuuuaaagugaucgaaggguggucuaauccuaaguccaaacugcagauuaacagacaggucaucguggaucggggaaaucgcagcggcuauucuggcauuuucuccgucgaggggaaaagcugcaucaacagauguuuuuacguggaacugauucggggaagaaaggaggaaacaggcguucucuggaccuccaauucuaucguggucuucugcgggacaagcggaacguauggcaccggguccuggcccgacggcgccgaucugaaccuuaugccuauuuga

SEQ ID NO: 207276 - RNA, 1410 nt, Artificial Sequence; identical to SEQ ID NO: 206995
  derived and/or modified sequence opt5 from neuraminidase__InfluenzaA__AHC61730

SEQ ID NO: 207277 - RNA, 1410 nt, Artificial Sequence; identical to SEQ ID NO: 207044
  derived and/or modified sequence opt5 from neuraminidase__InfluenzaA__AHC61742

SEQ ID NO: 207278 - RNA, 1410 nt, Artificial Sequence; identical to SEQ ID NO: 206995
  derived and/or modified sequence opt5 from neuraminidase__InfluenzaA__AHC61754

SEQ ID NO: 207279 - RNA, 1410 nt, Artificial Sequence; identical to SEQ ID NO: 202542
  derived and/or modified sequence opt5 from neuraminidase__InfluenzaA__AHC61766

SEQ ID NO: 207280 - RNA, 1410 nt, Artificial Sequence; identical to SEQ ID NO: 207031
  derived and/or modified sequence opt5 from neuraminidase__InfluenzaA__AHC61778

SEQ ID NO: 207281 - RNA, 1410 nt, Artificial Sequence; identical to SEQ ID NO: 207069
  derived and/or modified sequence opt5 from neuraminidase__InfluenzaA__AHC61790

SEQ ID NO: 207282 - RNA, 1410 nt, Artificial Sequence; identical to SEQ ID NO: 206999
  derived and/or modified sequence opt5 from neuraminidase__InfluenzaA__AHC61802

SEQ ID NO: 207283 - RNA, 1410 nt, Artificial Sequence; identical to SEQ ID NO: 206995
  derived and/or modified sequence opt5 from neuraminidase__InfluenzaA__AHC61814

SEQ ID NO: 207284 - RNA, 1410 nt, Artificial Sequence
  derived and/or modified sequence opt5 from neuraminidase__InfluenzaA__AHC61826
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcauugccugguccucuagcuccugucaugacggaaaggccuggcuccacguuugcaucacaggcgaugacaagaacgcuaccgccagcuucauuuacaauggccggcugguggauucugucguguccuggagcaaagagauccuucgcacccaggaaucugagugugugugcauuaacgggacauguacggucguuaugaccgacggauccgcuagcggcaaggccgauacaaaaauccuguuuaucgaggaagggaagauugugcauaccuccacacucucuggaagcgcgcaacacguggaggaaugcuccugcuaucccagauacccuggcguccggugugugugccgcgacaacuggaaggggagcaauagacccaucguugauauuaacaucaaagaccacucuauuguguccagcuacgucuguucuggacuggugggcgacaccccgcggaagaaugauagcuccucuagcucccauugccuugacccuaacaaugaggaaggcgggcacggaguuaaaggcugggccuucgaugacgggaacgauguguggaugggacgcacgaucaaugagacaagcagacugggcuaugagaccuuuaaggucaucgaaggguggucuaaccccaaauccaagcuccagauuaaucgccaggugaucgucgaccggagcgauagaucuggauacuccggcauuuucagcguggagggcaaauccuguaucaaccggugcuuuuauguugaacugauuagagggcgcaaggaggaaaccgaggugcuguggacaucuaauagcaucgucguguucuguggaaccuccggcacauacgggacgggaucuuggccugacggcgcugaucucaaccugaugcccauuuga

SEQ ID NO: 207285 - RNA, 1410 nt, Artificial Sequence; identical to SEQ ID NO: 206995
  derived and/or modified sequence opt5 from neuraminidase__InfluenzaA__AHC61838

SEQ ID NO: 207286 - RNA, 1410 nt, Artificial Sequence; identical to SEQ ID NO: 207031
  derived and/or modified sequence opt5 from neuraminidase__InfluenzaA__AHC61850

SEQ ID NO: 207287 - RNA, 1410 nt, Artificial Sequence; identical to SEQ ID NO: 207044
  derived and/or modified sequence opt5 from neuraminidase__InfluenzaA__AHC61862

SEQ ID NO: 207288 - RNA, 1410 nt, Artificial Sequence; identical to SEQ ID NO: 206995
  derived and/or modified sequence opt5 from neuraminidase__InfluenzaA__AHC61874

SEQ ID NO: 207289 - RNA, 1410 nt, Artificial Sequence
  derived and/or modified sequence opt5 from neuraminidase__InfluenzaA__AHC61886
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguugugcuuugugaaccuacaauuaucgagagaaauauuaccgaaaucguguaucugacaaacaccacgauugagaaggaaaucugccccaaaccugcugaguaccggcauuggagcaagccccagugugacauuaccggguucgccccuuuuuccaaagauaauucuauccgccucagcgcgggaggcgacaucugggucacaagagagccguauguguccugcgaucccgacaaguguuaccaauucgcucuggggcagggaaccacacuuaacaauguucacucuaacaauaccgugcgggaucgcacgccuuauagaacacugcucaugaacgaacugggcguccccuuucaucuggggaccaaacaggugugcauugccuggagcuccagcucuugucacgacggaaaggccuggcuccauguuugcaucacaggcgaugacaagaaugcuaccgccuccuucauuuacaacggccggcugguggauagcgucgugucuugguccaaagagauccuucgcacccaggaaagcgagugugugugcauuaaugggacauguacggucguuaugaccgacggaucugcuuccggcaaggccgauacaaaaauccuguuuaucgaggaagggaagauugugcacaccagcacacucuccggaucugcgcaacacguggaggaaugcagcugcuauccuagauaccccggcguccggugugugugccgcgacaacuggaagggguccaacagaccgaucguugauauuaauaucaaagaccauagcauugugucuuccuacgucuguagcggacuggugggcgacaccccucggaagaacgauucuagcuccucuagccacugccuugaccccaauaacgaggaaggcgggcauggaguuaaaggcugggccuucgaugacgggaaugauguguggaugggacgcacgaucaacgagacauccagacugggcuaugagaccuuuaaggucaucgaaggguggagcaauccuaaaucuaagcuccagauuaaccgccaggugaucgucgaccggggagauagauccggcuacagcggcauuuucucuguggaggggaaauccuguaucaaucggugcuuuuauguugaacugauuagaggacgcaaggaggaaaccgaggugcuguggacaagcaacuccaucgucguguucuguggcaccucugggacauacggaacgggcagcuggcccgacggggcugaucucaaucugaugcccauuuga

SEQ ID NO: 207290 - RNA, 1410 nt, Artificial Sequence; identical to SEQ ID NO: 206999
  derived and/or modified sequence opt5 from neuraminidase__InfluenzaA__AHC61898

SEQ ID NO: 207291 - RNA, 1410 nt, Artificial Sequence; identical to SEQ ID NO: 207031
  derived and/or modified sequence opt5 from neuraminidase__InfluenzaA__AHC61910

SEQ ID NO: 207292 - RNA, 1410 nt, Artificial Sequence; identical to SEQ ID NO: 202542
  derived and/or modified sequence opt5 from neuraminidase__InfluenzaA__AHC61934

SEQ ID NO: 207293 - RNA, 1410 nt, Artificial Sequence
  derived and/or modified sequence opt5 from neuraminidase__InfluenzaA__AHC61946
augaaccccaaucagaagaucauuaccaucggcagcgugucccugacaauuucuacgaucugcuucuuuaugcaaauugccauccucaucaccacagucacccugcacuucaaacaguacgagagcuauuccccuccgaacaaucagguuaugcuuugugaacccacaauuaucgagagaaacauuaccgaaaucguguaccugacaaauaccacgauugagaaggaaaucugcccuaaacucgcugaguaucggaacuggucuaagccccagugugacauuaccggguuugccccuuucagcaaagauaauuccauccgccugucugcgggaggcgacaucugggugacaagagagcccuacgucagcugcgauccugacaaguguuaucaauuugcucuugggcagggaaccacacugaacaaugugcauuccaacaauaccguucgggaucgcacgccguacagaacacuccugaugaacgaacugggcgugcccuuccaccucgggaccaagcaggucugcauugccuggucuagcuccagcugucaugacggaaaagccuggcugcacgugugcaucacaggcgaugacaagaaugcuaccgccucuuuuauuuauaacggccggcuuguugauuccguggucagcuggucuaaagagauccugcgcacccaggaauccgagugugugugcauuaaugggacauguacgguggucaugaccgacggaagcgcuuccggcaaggccgauacaaaaauccucuucaucgaggaagggaagauuguucauaccucuacacugagcggauccgcgcaacacguggaggaaugcagcugcuacccuagaaaccccggcgugcggugugucugccgcgacaacuggaaggggucuaauagaccuaucguggauauuaacaucaaagaccacuccauuguuagcucuuacguguguagcggacuugucggcgacacgccccggaagaaugauuccucuagcuccagccauugccuggacccgaacaaugaggaaggcgggcacggagugaaaggcugggccuuugaugacgggaacgauguuuggaugggacgcaccaucaaugagacaucuagacucggcuaugagaccuucaaggugaucgaagggugguccaacccuaaaagcaagcugcagauuaaucggcaggucaucguggaccgcggaaacagaucuggcuacuccggcauuuuuagcgucgaggggaaauccuguaucaaucggugcuucuauguggaacugauuagaggacgcaaggaggaaaccgagguucucuggacaucuaacagcaucguggucuuuuguggcaccuccgggacauacggaacgggcucuuggcccgauggggcugaccugaaucuuaugccuauuuga

SEQ ID NO: 207294 - RNA, 1410 nt, Artificial Sequence; identical to SEQ ID NO: 205946
  derived and/or modified sequence opt5 from neuraminidase__InfluenzaA__AHC61958

SEQ ID NO: 207295 - RNA, 1410 nt, Artificial Sequence; identical to SEQ ID NO: 206995
  derived and/or modified sequence opt5 from neuraminidase__InfluenzaA__AHC61970

SEQ ID NO: 207296 - RNA, 1410 nt, Artificial Sequence
  derived and/or modified sequence opt5 from neuraminidase__InfluenzaA__AHC61982
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacaugugcuguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacggaauuguuucuuccuacguguguagcggccuugucggcgacacaccccggaagaaugauucuagcuccucuagccauugccuggacccgaacaaugaggaagggggacacggcgugaaagggugggcuuucgaugacggaaacgauguuuggaugggccgcaccaucaaugagacguccagacucggguaugagacauuuaaggugaucgaaggauggagcaacccuaaaucuaagcugcagauuaaucggcaggucaucguggaccgcggcaacagauccggcuacagcgggauuuucucugucgagggaaaauccuguaucaaucggugcuuuuauguggaacugauuagaggccgcaaggaggaaaccgagguucucuggaccagcaacuccaucguggucuucugugggacaucuggaaccuacggcacagggagcuggcccgauggcgccgaccugaaucuuaugccuauuuga

SEQ ID NO: 207297 - RNA, 1410 nt, Artificial Sequence; identical to SEQ ID NO: 206999
  derived and/or modified sequence opt5 from neuraminidase__InfluenzaA__AHC61994

SEQ ID NO: 207298 - RNA, 1410 nt, Artificial Sequence; identical to SEQ ID NO: 207031
  derived and/or modified sequence opt5 from neuraminidase__InfluenzaA__AHC62006

SEQ ID NO: 207299 - RNA, 1410 nt, Artificial Sequence; identical to SEQ ID NO: 206995
  derived and/or modified sequence opt5 from neuraminidase__InfluenzaA__AHC62018

SEQ ID NO: 207300 - RNA, 1410 nt, Artificial Sequence; identical to SEQ ID NO: 205946
  derived and/or modified sequence opt5 from neuraminidase__InfluenzaA__AHC62030

SEQ ID NO: 207301 - RNA, 1410 nt, Artificial Sequence; identical to SEQ ID NO: 206999
  derived and/or modified sequence opt5 from neuraminidase__InfluenzaA__AHC62042

SEQ ID NO: 207302 - RNA, 1410 nt, Artificial Sequence; identical to SEQ ID NO: 207072
  derived and/or modified sequence opt5 from neuraminidase__InfluenzaA__AHC62053

SEQ ID NO: 207303 - RNA, 1410 nt, Artificial Sequence
  derived and/or modified sequence opt5 from neuraminidase__InfluenzaA__AHC62065
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacccgcugaguaccggaauugguccaagccucagugugacaucaccggguucgcccccuuuucuaaagauaacagcauucgccucuccgcgggaggcgacaucugggucacaagagagccuuaugugucuugcgauccggacaaguguuaccaauucgcucuggggcagggaaccacacuuaauaacguucauagcaauaacaccgugcgggaucgcacgcccuauagaacacugcucaugaaugaacugggcgucccuuuucaccuggggaccaaacaggugugcaucgccugguccucuagcuccugucaugacggaaaggccuggcuccacguuugcauuacaggcgaugacaagaacgcuaccgccagcuucaucuacaauggccggcugguggauucugucguguccuggagcaaagagauucuucgcacccaggaaucugagugugugugcaucaacgggacauguacggucguuaugaccgacggauccgcuagcggcaaggccgauacaaaaauucuguuuaucgaggaagggaagaucgugcauaccuccacacucucuggaagcgcgcaacacguggaggaaugcuccugcuaucccagauacccuggcguccggugugugugccgcgacaacuggaaggggagcaauagacccauuguugauaucaacauuaaagaccacucuaucguguccagcuacgucuguucuggacuggugggcgacaccccgcggaagaaugauagcuccucuagcucccauugccuugacccuaacaaugaggaaggcgggcacggaguuaaaggcugggccuucgaugacgggaacgauguguggaugggacgcacgauuaaugagacaagcagacugggcuaugagaccuuuaaggucaucgaaggguggucuaaccccaaauccaagcuccagaucaaucgccaggugauugucgaccggggagauagaagcggcuacucuggcaucuucuccguggaggggaaaagcuguauuaaccggugcuuuuauguugaacugaucagaggacgcaaggaggaaaccgaggugcuguggacauccaauucuauugucguguucuguggcaccagcgggacauacggaacgggcuccuggccugacggggcugaucucaaccugaugcccaucuga

SEQ ID NO: 207304 - RNA, 1410 nt, Artificial Sequence; identical to SEQ ID NO: 207130
  derived and/or modified sequence opt5 from neuraminidase__InfluenzaA__AHC62077

SEQ ID NO: 207305 - RNA, 1410 nt, Artificial Sequence; identical to SEQ ID NO: 207044
  derived and/or modified sequence opt5 from neuraminidase__InfluenzaA__AHC62089

SEQ ID NO: 207306 - RNA, 1410 nt, Artificial Sequence; identical to SEQ ID NO: 206995
  derived and/or modified sequence opt5 from neuraminidase__InfluenzaA__AHC62101

SEQ ID NO: 207307 - RNA, 1410 nt, Artificial Sequence; identical to SEQ ID NO: 207044
  derived and/or modified sequence opt5 from neuraminidase__InfluenzaA__AHC62113

SEQ ID NO: 207308 - RNA, 1410 nt, Artificial Sequence
  derived and/or modified sequence opt5 from neuraminidase__InfluenzaA__AHC62125
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcgggcacggagugaagggcugggccuucgacgaugggaaugacguuuggaugggacggacgaucaacgagacaagccgccucggcuaugagaccuuuaaagugaucgaaggguggucuaauccuaaguccaaacugcagauuaacagacaggucaucguggaucggggaaauaagagcggcuacucuggcauuuucuccgucgaggggaaaagcuguaucaaccgcugcuuuuauguggaacugauuagaggacggaaagaggaaaccgagguucucuggacauccaauucuaucguggucuucuguggcaccagcgggacauacggaacgggcuccuggcccgacggggcugaucugaaccuuaugccuauuuga

SEQ ID NO: 207309 - RNA, 1410 nt, Artificial Sequence
  derived and/or modified sequence opt5 from neuraminidase__InfluenzaA__AHC62137
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucaaugagacaagcagacucggcuaugagaccuuuaaggugaucgaaggguggucuaacccuaaauccaagcugcagauuaaucggcaggucaucguggaccgcggagauagaagcggcuacucuggcauuuucuccgucgaggggaaaagcuguaucaaccggugcuuuuauguggaacugauuagaggacgcaaggaggaaaccgagguucucuggacauccaauucuaucguggucuucuguggcaccagcgggacauacggaacgggcuccuggcccgacggggcugaucugaaccuuaugccuauuuga

SEQ ID NO: 207310 - RNA, 1410 nt, Artificial Sequence
  derived and/or modified sequence opt5 from neuraminidase__InfluenzaA__AHC62149
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccagcagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacauccgggaccacucuauuguuuccagcuacguguguucuggacuggucggcgacaccccgcgcaaaaaugauagcuccucuagcucccauugccuugacccuaacaaugaggaaggcgggcacggagugaagggcugggccuucgaugacgggaacgauguuuggaugggaagaacgaucaaugagacaagccggcugggcuaugagaccuuuaaagugaucgaaggguggucuaaccccaaguccaaacuccagauuaaucgccaggucaucguggacagaggagaucggagcggcuacucuggcauuuucuccgucgaggggaagucuuguaucaacagaugcuuuuauguggaacugauucgcggacggaaagaggaaaccgagguucuguggacauccaauucuaucguggucuucuguggcaccagcgggacauacggaacgggcuccuggccugacggggcugaucucaaccugaugcccauuuga

SEQ ID NO: 207311 - RNA, 1410 nt, Artificial Sequence; identical to SEQ ID NO: 207031
  derived and/or modified sequence opt5 from neuraminidase__InfluenzaA__AHC62161

SEQ ID NO: 207312 - RNA, 1410 nt, Artificial Sequence
  derived and/or modified sequence opt5 from neuraminidase__InfluenzaA__AHC62173
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccuaauaagugcuaucaauucgcucuugggcagggaaccacacugaacaaugugcauagcaacaauaccguucgggaccgcacgccguacagaacacuccugaugaacgaacugggcgugcccuuucaccucgggaccaagcaggucuguauugccugguccucuagcuccugccaugauggaaaagccuggcugcacguguguaucacaggcgacgauaagaaugcuaccgccagcuucauuuauaacggcaaacuuguugacucuguggucuccuggagcaaggagauccugcggacccaggaaucugagugcguguguauuaacgggacaugcacgguggucaugaccgauggauccgcuagcggcaaagccgacacaaagauccucuuuaucgaggaagggaagauuguucauaccuccacacugucuggaagcgcgcaacacguggaggaaugcuccuguuacccucgcuaucccggcgugagaugcgucugucgggauaauuggaaagggagcaaccgcccuaucguggacauuaauaucaaggaucacucuauuguuuccagcuacgugugcucuggacuugucggcgacacccccagaaagaacgacagcuccucuagcucccauugucuggauccgaauaacgaggaaggcgggcacggagugaagggcugggccuucgacgaugggaaugacguuuggaugggacggacgaucaacgagacaagccgccucggcuacgagaccuuuaaagugaucgaaggguggucuaauccuaaguccaaacugcagauuaacagacaggucaucguggaucggggaaaucgcagcggcuauucuggcauuuucuccgucgaggggaaaagcugcaucaacagauguuuuuacguggaacugauucggggaagaaaggaggaaaccgagguucucuggacauccaauucuaucguggucuucugcggcaccagcgggacauauggaacgggcuccuggcccgacggggcugaucugaaccuuaugccuauuuga

SEQ ID NO: 207313 - RNA, 1410 nt, Artificial Sequence; identical to SEQ ID NO: 207044
  derived and/or modified sequence opt5 from neuraminidase__InfluenzaA__AHC62185

SEQ ID NO: 207314 - RNA, 1410 nt, Artificial Sequence; identical to SEQ ID NO: 205946
  derived and/or modified sequence opt5 from neuraminidase__InfluenzaA__AHC62197

SEQ ID NO: 207315 - RNA, 1410 nt, Artificial Sequence
  derived and/or modified sequence opt5 from neuraminidase__InfluenzaA__AHC62209
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaaaaucacucuauuguuuccagcuacguguguucuggacuggucggcgacaccccgcggaagaacgacagcuccucuagcucccauugccuugauccuaauaacgaggaaggcgggcacggagugaaaggcugggccuucgacgaugggaaugacguuuggaugggacgcacgaucaacgagacaagcagacugggcuaugagaccuuuaaggugaucgaaggguggucuaaucccaaauccaagcuccagauuaaccggcaggucaucguggaucgcggagacagaagcggcuacucuggcauuuucuccgucgaggggaaaagcuguaucaaucggugcuuuuauguggaacugauuagaggacgcaaggaggaaaccgagguucuguggacauccaacucuaucguggucuucuguggcaccagcgggacauacggaacgggcuccuggccugauggggcugaccucaaucugaugcccauuuga

SEQ ID NO: 207316 - RNA, 1410 nt, Artificial Sequence; identical to SEQ ID NO: 206999
  derived and/or modified sequence opt5 from neuraminidase__InfluenzaA__AHC62221

SEQ ID NO: 207317 - RNA, 1410 nt, Artificial Sequence; identical to SEQ ID NO: 202542
  derived and/or modified sequence opt5 from neuraminidase__InfluenzaA__AHC62233

SEQ ID NO: 207318 - RNA, 1410 nt, Artificial Sequence; identical to SEQ ID NO: 206995
  derived and/or modified sequence opt5 from neuraminidase__InfluenzaA__AHC62245

SEQ ID NO: 207319 - RNA, 1410 nt, Artificial Sequence
  derived and/or modified sequence opt5 from neuraminidase__InfluenzaA__AHC62257
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucgugggacgcggcgacagaagcggcuacucugggauuuucuccgucgagggaaaaagcuguaucaaccggugcuuuuauguggaacugauuagaggccgcaaggaggaaaccgagguucuguggacauccaauucuaucguggucuucugugggaccagcggaacauacggcacgggguccuggccugauggcgcugaccucaaccugaugcccauuuga

SEQ ID NO: 207320 - RNA, 1410 nt, Artificial Sequence; identical to SEQ ID NO: 207072
  derived and/or modified sequence opt5 from neuraminidase__InfluenzaA__AHC62269

SEQ ID NO: 207321 - RNA, 1410 nt, Artificial Sequence; identical to SEQ ID NO: 207044
  derived and/or modified sequence opt5 from neuraminidase__InfluenzaA__AHC62281

SEQ ID NO: 207322 - RNA, 1410 nt, Artificial Sequence; identical to SEQ ID NO: 206999
  derived and/or modified sequence opt5 from neuraminidase__InfluenzaA__AHC62293

SEQ ID NO: 207323 - RNA, 1410 nt, Artificial Sequence; identical to SEQ ID NO: 202542
  derived and/or modified sequence opt5 from neuraminidase__InfluenzaA__AHC62305

SEQ ID NO: 207324 - RNA, 1410 nt, Artificial Sequence; identical to SEQ ID NO: 206995
  derived and/or modified sequence opt5 from neuraminidase__InfluenzaA__AHC62317

SEQ ID NO: 207325 - RNA, 1410 nt, Artificial Sequence
  derived and/or modified sequence opt5 from neuraminidase__InfluenzaA__AHC62329
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaauaacaccguucgggaucgcacgcccuauagaacacugcucaugaaugaacugggcgugccuuuucaccuggggaccaagcaggucugcauugccugguccucuagcuccugucaugacggaaaagccuggcuccacgugugcaucacaggcgaugacaagaacgcuaccgccagcuucauuuacaauggccggcugguugauucuguggucuccuggagcaaagagauccuucgcacccaggaaucugagugugugugcauuaacgggacauguacgguggucaugaccgacggauccgcuagcggcaaggccgauacaaaaauccuguuuaucgaggaagggaagauuguucauaccuccacacucucuggaagcgcgcaacacguggaggaaugcuccugcuaucccagauacccuggcgugcggugugucugccgcgacaacuggaaggggagcaauagacccaucguggauauuaacaucaaagaccacucuauuguuuccagcuacguguguucuggacuggucggcgacaccccgcggaagaaugauagcuccucuagcucccauugccuugacccuaacaaugaggaaggcgggcacggagugaaaggcugggccuucgaugacgggaacgauguuuggaugggacgcacgaucaaugagacaagcagacugggcuaugagaccuuuaaggugaucgaaggguggucuaaccccaaauccaagcuccagauuaaucggcaggucaucgcugaccgcggagauagaagcggcuacucuggcauuuucuccguggaggggaaaagcuguaucaaccggugcuuuuaugucgaacugauuagaggacgcaaggaggaaaccgaggugcuguggacauccaauucuaucguuguguucuguggcaccagcgggacauacggaacgggcuccuggccugacggggccgaucucaaccugaugcccauuuga

SEQ ID NO: 207326 - RNA, 1410 nt, Artificial Sequence; identical to SEQ ID NO: 206995
  derived and/or modified sequence opt5 from neuraminidase__InfluenzaA__AHC62341

SEQ ID NO: 207327 - RNA, 1410 nt, Artificial Sequence
  derived and/or modified sequence opt5 from neuraminidase__InfluenzaA__AHC62353
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaccgauagcuccucuagcucccauugccuggacccgaauaacgaggaaggcgggcacggagugaaaggcugggccuucgaugacgggaaugauguuuggaugggacgcacaaucaacgagaccagcagacucggcuaugagaccuuuaaggugaucgaaggguggucuaauccuaaauccaagcugcagauuaaccggcaggucaucguggaccgcggaaauagaagcggcuacucuggcauuuucuccgucgaggggaaaagcuguaucaaccggugcuuuuauguggaacugauuagaggacgcaaggaggaaacagagguucucuggaccuccaauucuaucguggucuucuguggcacaagcgggacguacggaaccggcuccuggcccgauggggcugaccugaaccuuaugccuauuuga

SEQ ID NO: 207328 - RNA, 1410 nt, Artificial Sequence; identical to SEQ ID NO: 206995
  derived and/or modified sequence opt5 from neuraminidase__InfluenzaA__AHC62365

SEQ ID NO: 207329 - RNA, 1410 nt, Artificial Sequence; identical to SEQ ID NO: 207212
  derived and/or modified sequence opt5 from neuraminidase__InfluenzaA__AHC62377

SEQ ID NO: 207330 - RNA, 1410 nt, Artificial Sequence; identical to SEQ ID NO: 207044
  derived and/or modified sequence opt5 from neuraminidase__InfluenzaA__AHC62389

SEQ ID NO: 207331 - RNA, 1410 nt, Artificial Sequence; identical to SEQ ID NO: 207044
  derived and/or modified sequence opt5 from neuraminidase__InfluenzaA__AHC62401

SEQ ID NO: 207332 - RNA, 1410 nt, Artificial Sequence; identical to SEQ ID NO: 207072
  derived and/or modified sequence opt5 from neuraminidase__InfluenzaA__AHC62413

SEQ ID NO: 207333 - RNA, 1410 nt, Artificial Sequence; identical to SEQ ID NO: 207130
  derived and/or modified sequence opt5 from neuraminidase__InfluenzaA__AHC62425

SEQ ID NO: 207334 - RNA, 1410 nt, Artificial Sequence; identical to SEQ ID NO: 202542
  derived and/or modified sequence opt5 from neuraminidase__InfluenzaA__AHC62437

SEQ ID NO: 207335 - RNA, 1410 nt, Artificial Sequence; identical to SEQ ID NO: 207044
  derived and/or modified sequence opt5 from neuraminidase__InfluenzaA__AHC62449

SEQ ID NO: 207336 - RNA, 1410 nt, Artificial Sequence; identical to SEQ ID NO: 206999
  derived and/or modified sequence opt5 from neuraminidase__InfluenzaA__AHC62461

SEQ ID NO: 207337 - RNA, 1410 nt, Artificial Sequence; identical to SEQ ID NO: 206995
  derived and/or modified sequence opt5 from neuraminidase__InfluenzaA__AHC62473

SEQ ID NO: 207338 - RNA, 1410 nt, Artificial Sequence; identical to SEQ ID NO: 205170
  derived and/or modified sequence opt5 from neuraminidase__InfluenzaA__AHC62485

SEQ ID NO: 207339 - RNA, 1410 nt, Artificial Sequence; identical to SEQ ID NO: 207044
  derived and/or modified sequence opt5 from neuraminidase__InfluenzaA__AHC62509

SEQ ID NO: 207340 - RNA, 1410 nt, Artificial Sequence
  derived and/or modified sequence opt5 from neuraminidase__InfluenzaA__AHC62521
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacagcuccucuagcucccauugccuggauccgaauaacgaggaaggcgggcacggagugaagggcugggccuucgacgaugggaaugacguuuggaugggacggacgaucaacgagacaagccgccucggcuaugagaccuuuaaagugaucgaaggguggucuaauccuaaguccaaacugcagauuaacagacaggucaucguggaucggggaaaucgcagcggcuacucuggcauuuucuccgucgaggggaaaagcuguaucaacagaugcuuuuauguggaacugauucggggaagaaaggaggaaaccgagguucucuggacauccaauucuaucauuguguucuguggcaccagcgggacauacggaacgggcuccuggcccgacggggcugaucugaaccuuaugccuaucuga

SEQ ID NO: 207341 - RNA, 1410 nt, Artificial Sequence
  derived and/or modified sequence opt5 from neuraminidase__InfluenzaA__AHC62533
augaaccccaaucagaagaucauuaccaucggcagcgugucccugacaauuucuacgaucugcuucuuuaugcaagucgccauucucaucaccacaguuacccugcacuucaaacaguacgaguuuaacagcccuccgaauaaccaggugaugcuuugugaacccacaaucauugagagaaauaucaccgaaauucuguaucucacaaacaccacgaucgagaaggaaauuugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcaucgccugguccucuagcuccugucaugacggaaaagccuggcuucacgugugcauuacaggcgaugacaagaacgcuaccgccagcuucaucuacaauggcaaacugguugauucuguggucuccuggagcaaggagauucuccggacccaggaaucugagugugugugcaucaacgggacauguacgguggucaugaccgacggauccgcuagcggcaaagccgauacaaagauucuguuuaucgaggaagggaagaucguucauaccuccacacuuucuggaagcgcgcaacacguggaggaaugcuccugcuauccucgcuaccccggcgugagaugugucugccgggacaacuggaaagggagcaaucgcccuauuguggauaucaacauuaaggaccacucuaucguuuccagcuacguguguucuggacuggucggcgacacccccagaaagaaugauagcuccucuagcucccauugccucgacccgaacaaugaggaaggcgggaacggagugaagggcugggccuucgaugacgggaaugauguuuggaugggacggacgauuaacgagacaagccgccugggcuaugagaccuuuaaagugaucgaaggguggucuaauccuaaguccaaacugcagaucaacagacaggucauuguggaccggggaaaucgcagcggcuacucuggcaucuucuccgucgaggggaaaagcuguauuaacagaugcuuuuauguggaacucauccggggaagaaaggaggaaaccgagguucuguggacauccaauucuauuguggucuucuguggcaccagcgggacauacggaacgggcuccuggcccgauggggcugaccuuaaccugaugccuaucuga

SEQ ID NO: 207342 - RNA, 1410 nt, Artificial Sequence; identical to SEQ ID NO: 207199
  derived and/or modified sequence opt5 from neuraminidase__InfluenzaA__AHC62545

SEQ ID NO: 207343 - RNA, 1410 nt, Artificial Sequence; identical to SEQ ID NO: 207044
  derived and/or modified sequence opt5 from neuraminidase__InfluenzaA__AHC62557

SEQ ID NO: 207344 - RNA, 1410 nt, Artificial Sequence; identical to SEQ ID NO: 206995
  derived and/or modified sequence opt5 from neuraminidase__InfluenzaA__AHC62569

SEQ ID NO: 207345 - RNA, 1410 nt, Artificial Sequence; identical to SEQ ID NO: 207044
  derived and/or modified sequence opt5 from neuraminidase__InfluenzaA__AHC62581

SEQ ID NO: 207346 - RNA, 1410 nt, Artificial Sequence
  derived and/or modified sequence opt5 from neuraminidase__InfluenzaA__AHC62593
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcaauaucugggugacaagagagcccuaugucucuugcgacccugauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaacgggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaauuggaaggggagcaacagaccuaucguggacauuaauaucaaagaucacucuauuguuuccagcuacguguguucuggacuugucggcgacacgccccggaagaacgacagcuccucuagcucccauugccuggauccgaauaacgaggaaggcgggcacggagugaaaggcugggccuucgacgaugggaaugacguuuggaugggacgcaccaucaacgagacaagcagacucggcuaugagaccuuuaaggugaucgaaggguggucuaauccuaaauccaagcugcagauuaaccggcaggucaucguggaucgcggaaauagaagcggcuacucuggcauuuucuccgucgaggggaaaagcuguaucaaccggugcuuuuauguggaacugauuagaggacgcaaggaggaaaccgagguucucuggacauccaauucuaucguggucuucuguggcaccagcgggacauacggaacgggcuccuggcccgacggggcugaucugaaccuuaugccuauuuga

SEQ ID NO: 207347 - RNA, 1410 nt, Artificial Sequence; identical to SEQ ID NO: 207031
  derived and/or modified sequence opt5 from neuraminidase__InfluenzaA__AHC62605

SEQ ID NO: 207348 - RNA, 1410 nt, Artificial Sequence
  derived and/or modified sequence opt5 from neuraminidase__InfluenzaA__AHC62617
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugagaugugaacccacaauuaucgagcggaauauuaccgaaaucguguaucuuacaaacaccacgauugagaaggaaaucugcccuaaacuggcugaguaccgcaauugguccaagccccagugugacauuaccggguucgccccuuuuucuaaagauaacagcaucagacucuccgcgggaggcgacaucugggugacacgggagcccuaugucucuugcgauccuaauaaguguuaccaauucgcucuggggcagggaaccacacuuaacaaugugcauagcaacaauaccguucgcgacagaacgccguaucggacacugcucaugaacgaacugggcgugcccuuucaccuggggaccaagcaggucugcauugccugguccagcagcuccugucaugauggaaaagccuggcuccacgugugcaucacaggcgacgauaagaaugcuaccgccagcuucauuuacaacggcaaacugguugacucuguggucuccuggagcaaggagauccuucgcacccaggaaucugagugugugugcauuaacgggacauguacgguggucaugaccgauggauccgcuagcggcaaagccgacacaaagauccuguuuaucgaggaagggaagauuguucauaccuccacacucucuggaagcgcgcaacacguggaggaaugcuccugcuauccuagauaccccggcgugcggugugucugccgcgauaauuggaaagggagcaacagaccuaucguggacauuaauaucaaggaucacucuauuguuuccagcuacguguguucuggacuggucggcgacacgccccggaaaaacgacagcuccucuagcucccauugccuugauccgaauaacgaggaaggcgggcacggagugaagggcugggccuucgacgaugggaaugacguuuggaugggacgcaccaucaacgagacaagcagacugggcuaugagaccuuuaaagugaucgaaggguggucuaauccuaaguccaaacuccagauuaaccggcaggucaucguggaucgcggaaauagaagcggcuacucuggcauuuucuccgucgaggggaagucuuguaucaaccggugcuuuuauguggaacugauuagaggacgcaaggaggaaaccgagguucuguggacauccaauucuaucguggucuucuguggcaccagcgggacauacggaacgggcuccuggcccgacggggcugaucucaaccugaugccuauuuga

SEQ ID NO: 207349 - RNA, 1410 nt, Artificial Sequence; identical to SEQ ID NO: 206999
  derived and/or modified sequence opt5 from neuraminidase__InfluenzaA__AHC62629

SEQ ID NO: 207350 - RNA, 1410 nt, Artificial Sequence
  derived and/or modified sequence opt5 from neuraminidase__InfluenzaA__AHC62641
augaaccccaaucagaagaucauuaccaucggcagcgugucccugacaauuucuacggucugcuucuuuaugcaaguugccauccucauuaccacagugacccugcacuucaaacaguacgaguuuaacagcccuccgaauaaccaggugaugcuuugugaacccacaaucaucgagagaaauauuaccgaaauccuguaucucacaaacaccacgauugagaaggaaaucugcccuaaacuggcugaguaccggaauugguccaagccccagugugacauuaccggguucgccccuuuuucuaaagauaacagcauccgccuuuccgcgggaggcgacauuugggucacaagagagcccuaugugucuugcgauccugacaaguguuaccaauucgcucuggggcagggaaccacacucaauaacguucauagcaauaacaccgugcgggaucgcacgccguauagaacacugcugaugaaugaacucggcguccccuuucaccuggggaccaaacaggugugcaucgccugguccagcagcuccugucaugacggaaaagccuggcuucacguuugcaucacaggcgaugacaagaacgcuaccgccagcuucauuuacaauggcaaacugguggauucugucguguccuggagcaaggagauccuccggacccaggaaucugagugugugugcauuaacgggacauguacggucguuaugaccgacggauccgcuagcggcaaagccgauacaaagauccuguuuauugaggaagggaagaucgugcauaccuccacacuuucuggaagcgcgcaacacguggaggaaugcuccugcuauccucgcuaccccggcgucagaugugugugccgggacaacuggaaagggagcaaucgcccuaucguugauauuaacaucaaggaccacucuauuguguccagcuacgucuguucuggacuggugggcgacacccccagaaagaaugauagcuccucuagcucccauugccucgacccgaacaaugaggaaggcgggcacggaguuaagggcugggccuucgaugacgggaacgauguguggaugggacggacgaucaaugagacaagccgccugggcuaugagaccuuuaaagucauugaaggguggucuaacccuaaguccaaacugcagaucaauagacaggugaucgucgaccggggaaaccgcagcggcuacucuggcauuuucuccguggaggggaagucuuguaucaauagaugcuuuuauguugaacucauucggggaagaaaggaggaaaccgaggugcuguggacauccaacucuaucgucguguucuguggcaccagcgggacauacggaacgggcuccuggcccgauggggcugaccuuaaucugaugccuauuuga

SEQ ID NO: 207351 - RNA, 1410 nt, Artificial Sequence; identical to SEQ ID NO: 206999
  derived and/or modified sequence opt5 from neuraminidase__InfluenzaA__AHC62653

SEQ ID NO: 207352 - RNA, 1410 nt, Artificial Sequence; identical to SEQ ID NO: 206999
  derived and/or modified sequence opt5 from neuraminidase__InfluenzaA__AHC62665

SEQ ID NO: 207353 - RNA, 1410 nt, Artificial Sequence
  derived and/or modified sequence opt5 from neuraminidase__InfluenzaA__AHC62677
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacaauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggcaaacuuguugacucuguggucuccuggagcaaggagauccugcggacccaggaaucugagugugugugcauuaacgggacauguacgguggucaugaccgauggauccgcuagcggcaaagccgacacaaagauccucuuuaucgaggaagggaagauuguucauaccuccacacugucuggaagcgcgcaacacguggaggaaugcuccugcuauccucgcuaccccggcgugagaugugucugccgggauaauuggaaagggagcaaccgcccuaucguggacauuaauaucaaggaucacucuauuguuuccagcuacguguguucuggacuugucggcgacacccccagaaagaacgacaucagcuccucuagccauugccuggauccgaauaacgaggaaggcgggcacggagugaaaggcugggccuucgacgaugggaaugacguuuggaugggacggacgaucaacgagacaucccgccucggcuaugagaccuuuaaagugauugaaggguggagcaauccuaagucuaaacugcagaucaacagacaggucauuguggaucggggaaaucgcuccggcuacagcggcaucuucucugucgaggggaaguccuguauuaacagaugcuuuuauguggaacugauccggggaagaaaggaggaaaccgagguucucuggacaagcaauuccauuguggucuucuguggcaccucugggacauacggaacgggcagcuggcccgacggggcugaucugaaccuuaugccuaucuga

SEQ ID NO: 207354 - RNA, 1398 nt, Artificial Sequence
  derived and/or modified sequence opt5 from neuraminidase__InfluenzaA__AHF20560
augaaccccaaucagaagauccugugcaccagcgccacagcuauuaucauuggcgccaucacggugcucauugggaucgcgaaccugggacuuaauaucggccugcaccucaaaccuggguguaacugcucccauucucaaccggagaccacaaauaccagccagacaauuaucaacaauuacuauaacgaaaccaauacaaccaacauucagauggaggaaagaacgucccggaauuucaacaaucugaccaagggacuuuguacaaucaacucuuggcacauuuacggcaaagacaaugcuguccgcaucggggagagcuccgauguucuggugaccagagaacccuaugugucuugcgacccugaugagugucgguuuuacgcccucagccagggaacaaccauucgcggcaagcauuccaacggcacgauccacgacagaagccaauaucgggcccugaucucuuggccccuguccagcccucccacagucuacaacucucgcguggagugcauugggugguccagcaccucuugucaugauggaaaauccagaaugagcaucugcauuuccggcccuaauaacaaugcuucugccguugugugguauaaccggcgcccggucgcugaaaucaauacaugggccagaaacauucuccggacccaggagagcgaaugugugugccacaaugggguuugucccguggucuucaccgacggauccgcgacaggcccugccgauacgcgcaucuacuacuuuaaggaggggaagauccugaaaugggagagccuuaccggaacagcuaagcacauugaagagugcucuugcuauggcgaaagaaccggcaucacauguaccugccgggacaacuggcagggguccaaucgccccgugauucagaucgauccuguggccaugacgcauacaagccaauacauuuguucucccguccugaccgacaacccgagaccuaaugaucccaacaucggaaaaugcaaugacccuuaucccggcaacaauaacaacgggguuaagggauucagcuaccucgauggcgcuaauaccuggcuggggcggacaaucuccaccgccucuagaagcggauaugagaugcuuaaagugcccaacgcgcugacagacgaccgcuccaagccuauucagggccagacgaucgugcucaaugccgauuggagcggcuacucuggguccuuuauggacuauugggcugaaggagauuguuaccgggccugcuucuacgucgagcugauuagaggccgcccgaaggaggacaaagugugguggaccagcaacucuaucguuuccauguguagcuccacagaauuucuggagcaguggaauuggcccgauggggcuaagauugaauauuuccucuga

SEQ ID NO: 207355 - RNA, 1398 nt, Artificial Sequence; identical to SEQ ID NO: 206478
  derived and/or modified sequence opt5 from neuraminidase__InfluenzaA__AHF20570

SEQ ID NO: 207356 - RNA, 1413 nt, Artificial Sequence; identical to SEQ ID NO: 199656
  derived and/or modified sequence opt5 from neuraminidase__InfluenzaA__AHG96111

SEQ ID NO: 207357 - RNA, 1413 nt, Artificial Sequence; identical to SEQ ID NO: 199656
  derived and/or modified sequence opt5 from neuraminidase__InfluenzaA__AHG96123

SEQ ID NO: 207358 - RNA, 1413 nt, Artificial Sequence; identical to SEQ ID NO: 199656
  derived and/or modified sequence opt5 from neuraminidase__InfluenzaA__AHG96135

SEQ ID NO: 207359 - RNA, 1413 nt, Artificial Sequence; identical to SEQ ID NO: 199656
  derived and/or modified sequence opt5 from neuraminidase__InfluenzaA__AHG96147

SEQ ID NO: 207360 - RNA, 1413 nt, Artificial Sequence; identical to SEQ ID NO: 199656
  derived and/or modified sequence opt5 from neuraminidase__InfluenzaA__AHG96159

SEQ ID NO: 207361 - RNA, 1413 nt, Artificial Sequence; identical to SEQ ID NO: 199656
  derived and/or modified sequence opt5 from neuraminidase__InfluenzaA__AHG96171

SEQ ID NO: 207362 - RNA, 1413 nt, Artificial Sequence; identical to SEQ ID NO: 199656
  derived and/or modified sequence opt5 from neuraminidase__InfluenzaA__AHG96183

SEQ ID NO: 207363 - RNA, 1413 nt, Artificial Sequence; identical to SEQ ID NO: 199656
  derived and/or modified sequence opt5 from neuraminidase__InfluenzaA__AHG96195

SEQ ID NO: 207364 - RNA, 1413 nt, Artificial Sequence; identical to SEQ ID NO: 199656
  derived and/or modified sequence opt5 from neuraminidase__InfluenzaA__AHG96207

SEQ ID NO: 207365 - RNA, 1413 nt, Artificial Sequence; identical to SEQ ID NO: 199656
  derived and/or modified sequence opt5 from neuraminidase__InfluenzaA__AHG96219

SEQ ID NO: 207366 - RNA, 1413 nt, Artificial Sequence; identical to SEQ ID NO: 199656
  derived and/or modified sequence opt5 from neuraminidase__InfluenzaA__AHG96231

SEQ ID NO: 207367 - RNA, 1413 nt, Artificial Sequence; identical to SEQ ID NO: 199656
  derived and/or modified sequence opt5 from neuraminidase__InfluenzaA__AHG96243

SEQ ID NO: 207368 - RNA, 1413 nt, Artificial Sequence; identical to SEQ ID NO: 199656
  derived and/or modified sequence opt5 from neuraminidase__InfluenzaA__AHG96255

SEQ ID NO: 207369 - RNA, 1413 nt, Artificial Sequence; identical to SEQ ID NO: 199656
  derived and/or modified sequence opt5 from neuraminidase__InfluenzaA__AHG96267

SEQ ID NO: 207370 - RNA, 1413 nt, Artificial Sequence; identical to SEQ ID NO: 199656
  derived and/or modified sequence opt5 from neuraminidase__InfluenzaA__AHG96279

SEQ ID NO: 207371 - RNA, 1413 nt, Artificial Sequence; identical to SEQ ID NO: 199656
  derived and/or modified sequence opt5 from neuraminidase__InfluenzaA__AHG96291

SEQ ID NO: 207372 - RNA, 1413 nt, Artificial Sequence; identical to SEQ ID NO: 199656
  derived and/or modified sequence opt5 from neuraminidase__InfluenzaA__AHG96303

SEQ ID NO: 207373 - RNA, 1410 nt, Artificial Sequence; identical to SEQ ID NO: 199480
  derived and/or modified sequence opt5 from neuraminidase__InfluenzaA__AHG96362

SEQ ID NO: 207374 - RNA, 1410 nt, Artificial Sequence; identical to SEQ ID NO: 199480
  derived and/or modified sequence opt5 from neuraminidase__InfluenzaA__AHG96374

SEQ ID NO: 207375 - RNA, 1410 nt, Artificial Sequence; identical to SEQ ID NO: 199480
  derived and/or modified sequence opt5 from neuraminidase__InfluenzaA__AHG96386

SEQ ID NO: 207376 - RNA, 1413 nt, Artificial Sequence; identical to SEQ ID NO: 199656
  derived and/or modified sequence opt5 from neuraminidase__InfluenzaA__AHG96398

SEQ ID NO: 207377 - RNA, 1410 nt, Artificial Sequence; identical to SEQ ID NO: 199480
  derived and/or modified sequence opt5 from neuraminidase__InfluenzaA__AHG96410

SEQ ID NO: 207378 - RNA, 1410 nt, Artificial Sequence; identical to SEQ ID NO: 199480
  derived and/or modified sequence opt5 from neuraminidase__InfluenzaA__AHG96422

SEQ ID NO: 207379 - RNA, 1410 nt, Artificial Sequence; identical to SEQ ID NO: 199480
  derived and/or modified sequence opt5 from neuraminidase__InfluenzaA__AHG96434

SEQ ID NO: 207380 - RNA, 1410 nt, Artificial Sequence; identical to SEQ ID NO: 199480
  derived and/or modified sequence opt5 from neuraminidase__InfluenzaA__AHG96446

SEQ ID NO: 207381 - RNA, 1410 nt, Artificial Sequence; identical to SEQ ID NO: 199480
  derived and/or modified sequence opt5 from neuraminidase__InfluenzaA__AHG96458

SEQ ID NO: 207382 - RNA, 1410 nt, Artificial Sequence; identical to SEQ ID NO: 199480
  derived and/or modified sequence opt5 from neuraminidase__InfluenzaA__AHG96470

SEQ ID NO: 207383 - RNA, 1410 nt, Artificial Sequence; identical to SEQ ID NO: 199480
  derived and/or modified sequence opt5 from neuraminidase__InfluenzaA__AHG96482

SEQ ID NO: 207384 - RNA, 1410 nt, Artificial Sequence; identical to SEQ ID NO: 199480
  derived and/or modified sequence opt5 from neuraminidase__InfluenzaA__AHG96494

SEQ ID NO: 207385 - RNA, 1410 nt, Artificial Sequence; identical to SEQ ID NO: 199480
  derived and/or modified sequence opt5 from neuraminidase__InfluenzaA__AHG96506

SEQ ID NO: 207386 - RNA, 1413 nt, Artificial Sequence; identical to SEQ ID NO: 199656
  derived and/or modified sequence opt5 from neuraminidase__InfluenzaA__AHG96518

SEQ ID NO: 207387 - RNA, 1413 nt, Artificial Sequence; identical to SEQ ID NO: 199656
  derived and/or modified sequence opt5 from neuraminidase__InfluenzaA__AHG96530

SEQ ID NO: 207388 - RNA, 1413 nt, Artificial Sequence; identical to SEQ ID NO: 199656
  derived and/or modified sequence opt5 from neuraminidase__InfluenzaA__AHG96542

SEQ ID NO: 207389 - RNA, 1413 nt, Artificial Sequence; identical to SEQ ID NO: 199656
  derived and/or modified sequence opt5 from neuraminidase__InfluenzaA__AHG96554

SEQ ID NO: 207390 - RNA, 1413 nt, Artificial Sequence; identical to SEQ ID NO: 199656
  derived and/or modified sequence opt5 from neuraminidase__InfluenzaA__AHG96566
